United States Patent 12,180,497 (RESISTANCE GENES ASSOCIATED WITH DISEASE RESISTANCE IN SOYBEANS) - sequence listing, part 4

SEQ ID NO: 3 - DNA, 2093669 bp, Glycine canescens
aaacccaaaccccaaaccccaaaccccccccccccccccccaaaccccaaaccccaaaccccccaaaccccaaacccccaaccccaaccccaaccccaaaccccaaaccccaacccaacccaaaccccaaaccccaaaccccaaccccaaaccccaaaccccaaaaccccaaacccccccaaacccccccaaccccaaccccaaaccccaagccccaaaccccaagccccaaaccccaagccccaagccccaagccccaagccccaagccccaagccccaagccccaagccccaagccccaagccccaagccccaagccccaagccccaagccccaagccccaagccccaagccccaagccccaagccccaagccccaagccccaagccccgagccccaagccccgaaccccaagccccgaacccccaagccccaagccccgaaccccgaaccccgaacccgaacccccaaccccgaaccccgaacccccaaccccgaacccgaaccccaaccccgaacccgcaacccccaaccccgaaccccccaacccccaccccgaaccccaaccccaaccccgaccccgcaaccccgaaccccgaaccccaaccccgccccacccccaccccaaccccgaacccccaaccccgaaccccgaaccccccaaccccgaaccccgaccccccaacccaaaacccccgaaccccccaaccccaaaaccccgaaccccccaaccccaaaaacccccgaaccccccaaccccgaaaccccgaaaccccgaaccccgaaaccccgaaaccccgaaaccccgaaccccgaaaccccgaaaccccgaaaccccgaaaccccgaaccccgaaaccccgaaaccccgaaccccgaaaccccgaaaccgcgaaaccccgaaaccccgaaaccccgaaccccgaaaccccgaaaccgcgaaaccccgaaaccccgaaaccccgaaccccgaaccccgaaaccccgaaaccccgaaaccccgaaaccccgaaccccgaaaccccgaaaccccgaaaccccgaaacccgaaaccccgaaccccgaaaccccgaaaccccgaaaccccgaaccccgaaaccccgaaccccgaacccccaaacccaaaccccgaacccctaaaccctaattttccccctaagtatttaaaaaagaaactacaaacttgtattaaaagttaagaaaatacttgtctcaacttgtcagtgatttctgttttcctgggtttcatcatccgacccataagagatacaatatcttgtccccctttaggtcgtgcattggcagccagatcatgtagggttacatcctttaagaacaacaatccaaatctatcaaatatatatagtatactcaatgtctagaacaggttcttatagagtgcactaatacaagcctttgattaaaacaatcaaatatttaatatatcaatcaaatttcaataaaaaaaatggaaattaatatttaatggtatatttatatttgttatcaatattttattctaactacatacattaaaataatttttattatatattctatacaaaaaattattttttttaaagttaaaattttcaattaaaccaaatttattaatctgaaacaagcaataaatatttcaatttatattgttcttatgttctataattatagttccgttttatttccaatttcttcttccttgttttttgttggtaaaaattacattatgttgaatctgatgcatggccttttgaacctacacagatattattgatctggtgtcttacagatctattcaaatttgtttattgcctaaactaacttttaagctgattaggaaaagtattattattcttaaattactgaacttttggtggccagatgatgggaagggttttgtttcaatttttggatcaggagtcttgagtgatatgtggttgtaccacttggaaaacgaataataaagattgaagagtactgaaacagaatacggatacagaacatatgttgagattttcctgaggagaatgtccagtgcattttatgaccaagtgtattgatgtcttgtacatattagtgggtatgagatacactaaaccctacaccccacaccccaaaccccaaaaaaaaccaaaaaccctaaccctaaaaatgtcaaacccccaaatcccataccccaaaaccccaaaaccccaaaccccaaacatatcaaatatcataattcaggtttatcatatagaggaaacacagctcgatacactaattgttacaaattatacttaccacgtccttcccacatcatctgatgtctttgtcacaatgaacttagtagtatagtaacactcctaaacagcatatacatcatataatcatatctcgggaaatcctatcccaaagcacaacttgattatctttactctcaacaacagtatccctagccaaaaatatctacacaatcatgcaaaagaacaaatcaatgaatcttaacaaaaagaaaaaataagagcaaaaagtcagtaaatgagaaaaaccaatatggcataaatacatacgtaaagcattctgggattagatgtagtcactattgtgttacagttcacaaaacattgtacactttcctatatataaccaatgactaaaattcacatatgcacattttttcaatatcattagatggaagcatatattttttcctagttggataagcctcagttttcaaataaagcaaacagagcagcataaaatctagaaatttgaaccaaagttatcagaaatgtaaagttttttattcatattgtacaatttaattatattctcaaaaacatcaattcatgtcatcaatacaaatctgggaagacacaaattgtggctagactagagtgaggattctactagtgcatcatccagataaagcccacattagttagggtcctgtattgacccaaatgaggaaatccacctattttcacaaactttgttgaggtgacgacaacagcaaagatatttaattcgattttcttatatggtggcatccctcattttgagccaaattttatgaagattgagttttctagaaacaaaaattctttcaatgtttgtcacttataaggatacagtaagaaattgtagcagcaagcatttaagtatattgaacagtatccatatcaagttattaaaattgagtactaaaacaactagaaaatgattagtgtttaggtaagaaaggagaaaagagactcagaataagaggataccaaattgctgtggtatattatgattcaacacaaaaaaaaaaacagaacattaaaccccattagtgatagtactagactaatagtattaatcataaagaaatattacaaaatctagaaaaaaactacttagaaatcatacgaataagatattcagatatacactaggaccaaacattctagcataaacataaaatttgaacaattacagagtatttgattaaacactcagaaaaagacctttgaatcacaacttgacaatgattataataactgaagtaccttgcttgcaagtagaaaaaaagtggccattgaaccagaggaagatccccagaattcctaggcattaaaagcaactccatttcgctgtgagcaaggaaaacatgaccattcaggtattaattaagaaggaaagaagaaagataaataaaaccaagaaaatgtatagcagcttccatgactaacaagttggttacataatcctcctcccttagatttcttatgatctcattccaaaagggggcaaaccgagcagcatcaaccttgttattctccgcaaccttcggatgaagagtaattgaataagtaatatttactcaagtttaaaacaaatgttcagcaaacatgagaccagtgtactgtaaccttcccatcaacataaaaagtttcttattttagtgttagtacacaggtatcaagcaaataaacatgaatttagaccaaattatgtcttcctttatctatagcaaaaggctgacctgaatagacgactgatgggaactcctgaaaatataaaaattgagaaaaactatataagcttatacaaaaaatagtactatttaaggggaaaatctgaaagaagagaggatatattctcagagagctacaacagagataggacacatacatatacaattatcttccaaaaatacagaatgaagatcataaaacaggaaaaagcacatttcacaagcagcaccttttgggtagaggaacatgaagtgtgtccataaaagctccaggaaactgctcaaaaagtttgtgcagtgcttccaatgacctaatctggtgaccgcatacaaccacaaaaaaagttatgccaactaatcttaaattcttaaatatacaggacaagtgtgtaaaacacataaatatctagaagataaatctgaaagaatgggaattaacaaatcggaaacagccatcaaaacactcaaaaatgggagggggaagcaattttacaaaacagttaaattgaaggttttcccatcacctaaaagcttctatactatttattaactactaaaccagtgaaatacaaccctcaatactaagttcagcaactcctgaagatataatacgcttacttggggacttcttactccagctgttccaagagtctccgctagtggaaccccatctaatattttcaaactcctgaagatgtcatttttaaattgctcaaacaagatatttttgctgcaaacttttattgaatgcaaataaagctaaatccaaaaaagctatgaaactgcatgcataacagactatattaacaaccctgccactatacaccaaactttaaggacctcttgtcagacattcttccccattgagaaagacagattaaaaagaaacaacatatcctccttttatgattaaaatatttaaagaagggggaaggaggtaaacaaacaatgaaactatacttacaacaaccacaggagtccacacgctaacaactttcaaagtcactgattattttaatctagttattatgaaatattttctcacattacaaatatgtatgaagtttgtaagaaataacacaagatttaagtgacacaattgcaaaactcttcacttgttgtatatattataaaagcataatatagcactcgagttggaaattttaaaactgatcataatttaaaaaaagggatgaccgatgaccattcctcattttcatcaattcaagatagagctttgtttcacatggaaagaagcaagttcttgaaagaaaattgaattcaatgtcatgaaggaactcaacaaacaggcaacaataactatttttcttggatcaattctttcatttgtaaaatttggccaacctttccttcccctcgaaaccctaagacccaaagaaaacctaatgcaaatcacatgcatgtcatgtagcgtgtctttaatataattgtaatcacaaagagacaaataaggccaacaagcagttatagattatttaaaggaaatgaaaggaaataacagaccggaagaagaggagttgttgtcatgattgttcttccccgaggcgctgacaacaaatgggcgataccctttagagtaagggtttctcctcaaaacagtgatctgaaacactttgctccttcccaaattgaagggaatgggtctgtggcaaaacgaatttgtgtggaaaaggttctttgcatgaacagcaaacagatccattgtcacttttttactgcctttatcgtttctggatcgatgacgaacggctaagctaagaagcgagaaggatagaattggaaaaataattttagaaaaataaagatagtaagtggagcaacaacagaagacgatcacgaagaggatgaagaaagacactagtacgattatgaaaacgacgctttggaattggaaagagagagaatatgctttatttaaaccgaattgtgtggaggtcagcactggcgtacgttagccacaacctcctatgcgatctaaaattgcgctggcaaagataacattaatctaatttgattgcttgccaatagttacctatccattcctctctccaaatcggttaactgaattcaactaaccttaatctaatctggtgggttgtaaattgagttaaattgattaatcattctttttttttggaaaaaaataaatatctcgtaaattcagtcattcattaaataaataaataatttaaacataatatcatagtcacaaaaatatttcgttattatattattttatcacaactattatttttttaaataggggtattatcatcacaagttaaataaacttaaaataaaataataaaataacatgaaaatactcttatgtgattcttattataagacaaaatttaaaatgaattgatgaattttttataaggcatttcacaattcttatgtaatatttaatttttattaattgttattattaaatattttaaattttttaaatattttttcatgtcttaaatataaacaacacaaatttcttatttttttatttgaaatataaacaaatcttaacttataaagtattatttaatgagattatacttagaatatcctttatttaatatagttaacctttttatgtttaatatcaaatttcaataaaagatagcttaggaaaaaagattattttttagagaaatgataggaacacactcattcacacaccattttattcattggctgaaatttattgaaaatgaaaaaatctgataggtctcacatcacatataatgattatcttgattttataattttcaataaattttcatcaattagagagagtgtttgaagtagtgtgttagagaaagtgttcctaatatttttctattttttatttagaatgacataatttaatgaagttcactaatttcctaaataagtgtgaaacatgtctttttcttcttataatcaagactcgagagtcgagagagtatttgtacttgttattgatggtgattcaggactcttagactttaatatttctgcatcactcataacaagttaatgattattaataaggataaaattgatacattagtagtatttattttaaaagtcaataaaatgaactacataaatttttttattgatttgtgtgattatctccaaagggccttatttagaccatagggggtaattcacaatatatcatgtccaatgaatttctccagggatgttttggtgcaaaaaaagtgttgttttgcctcaaaaaccaacaaatgggcgggatagaggtggtaaaaacaatgtcatgtttaaagataaaatgagagggcatcaagtggaccttccaaggagggaagaagtgaatttgatagtaaataacatattcataattgagtttgaagagggagatcatataaagccttagtttcttcatgatgcatggtaggttgaaaacaatatgcaaattgacagacaattttgaagtggtggatgtagggcacaatttttacatggtgtagtttgatcttttgcaatatagggaaaatgtgattagcaggggtcagtaattggtctaccatcaatgcataaactcacttgtagagcaacatcttccaaggtaaagcaacatgaatcaattattgaagtcagattgaacatgttttcttaatgaaatgactgtctatgtcaatgtgcttggatctctcttggcaaattggatatcaaattgtatagttaatttctaataactcacaatacactgtaattccaaccacataatttcatacgaattatttagtaaaagggattgcctaagaatatctgtaataacaataatttaaaattttggtatacaaatctttttaagtctttttcacgttagtattcttagatttattaactatttatatccttttatgaatacattcaaactccacatatctagatttctcccaaaatttccatagagttctgtaagactgagaagatggcgaagaggatgtcttgtccttttcttgatcatagtctaagcctatatttgtccaatggatccttatgacttttttaaaagcatttttagcatgtttgatccatccaaaaatcttattaagtctatagtaagacatgttatttcccctttcagttttaagacttcaaataaataatcagtcttatcaattactttagctctttcaagagtttcttctaaagtcttaacctttttctcaaaaatcatagttgatttctttagagaaatattttcacaaacaacttgtactttctttatacttatattccacaaaaatcacatgtgtgttttgaagaacatcataagccatttcctcatcatttgataaagattaagatgaactactactatcaaactcaaaaaagttcttacattatcatttattgatccactcgatgagctcttaaacttgttcatgtgtgctttgaggaaggctttttcttttcaaatttttcgtctttcttggttggactctccaacattcaaactataagatttaagaaaataaattgtgagagtgtggattaatttcaaaagagttactcttagataaacttaatccatcctttattattattattccctccaatgattctaataagtagttaatattacccattgaacaggaaaaagttttcaatggtaagtgatagacatatacaatagaaacttgtttttgttttaaggggcgtttttatcactaaaaataacgactttccaggggagtttaaatagcaatggaggatggaaatagcaaagtccatcaagaattctcctactctgcaaaatttattttggatatgtttttgggtatcttaagagacagaaacattatgtttttagtaatgatcatgtttagggtaagtatttgctgttagttcttgtcttttcaccaatattttgttttatattaataggttttggtatgatgctacttgtaattaagttttatgcaacaatccttgcccattttgtgcttggatttgactattaataattatacatttatagaagaagaaaagtaaatttgaattatttaattttgggagaggatcacaggttcattttttaatataatgacttatgcttgctaaaattttcttcttttctttattattattagtctttagaaaacattgaataatttaggtaatgaacaaaattcattggcctatttgggctcattggcttgtttaagcctataggtctattgacttgtttatagacccttatatagaagtagactttcatatcagattagacttttaaacaggtcaagttaagacttaaaaaaatacatgtaataagtaaataaatcaggctcaaacttagtaattatgatgtaaatcaggctcatacctgtcaaagcctgaccaaagtctgacctaacctatttccacctctactcacatctaaatcaggagaatgaatcattaatgagatgtgagacccaccaaaatatattgtaactcgagaatagaagaaaaccaacaaattcatctgaagacccctgattttttcttctattcgttaacaggcccgagaagttaatagtacaattaataacttatcgagaaattgaaatattcaatcagattacaggattagaaaacacagaagcacaaacattatatttaaacatggaccacgataaactacacaaaggttattaacataccctaagaggaatcaaaatggacagataggcatacattaaaaccctttgcaatcagggcagtcactcttttaaactaaatcttgcattttgaacctttactgatagctttaacttctgttcttccatatcctttagcaaagccagcaagtttgctctataaacttcacatcgttgatttgtgacctctaactcagcagtcaactctcggattttcttttgcttctcggcctgttgcataggatccaaagggaatttgtttataataccacgtgtattaacaaaaatacaggccacatattgttaaaaatcagatacggataaattgaaataataatttcttattcattcactcactcattcatccattcattcactcatccatcacctcttaaatgaggaatatttatacaagtaatgttaacatcctgagcacaatattaggaaacaataatttaaacttattcttatctagactattttaacaacctgttcctatctaagagaaacaataattcaaattcaaattctatattcaacacatataggaagatgttgtcagttctcactctaatgtgtacgcttaggaaaatccaaatacacataaattttgtgccataattctataaaataattagtgaaaaggaaactttatatatagcataatgttaaaaacttagcaagatgagcacaaatataatccatgaaaacagcctcaattttaagaggttcaatttaaacttacaggctaagcaaattcaatttcttaaattactggagaagatgagaaaaaaagatcaccatggtcatagaagttgcagaagtccatcatagacaaacaagcacgttataaccacaacataagcaatacagattcttcacataaaatagtataaatagcacatatttttcaagggaaaattacaatcagcctcttaaactttgaaccttttgcaaaatggcaccaccaacgttaaatttgtcccaatctattaactttaaaaaatattacaatagacccttctgtttagctaccatttaactcaacaagggaagagctacgtgacatctaattcattcattttatgaaaaatctctttgttttaaaatataatttacgaggtttttaaataatcatcaatttaaaaaatagtaagtggcatcgagtccaaccaccatgccacaacatcactcaaacagtaaccatgtaccacaaaaatcttgcacaaaaataaatgagacagagacagagaaatctataatgcattaatcctaaaccatcactcaccatcaccaccacccactgtcaccagccagaacataggttaaaatcaagatgcaacctgtctacaactgcatgcacaccaaagcatagctccccaaccaaaatgtgcaaacccactaattctagagatttgatcatcaaagtgatatttacctcttcctaattcaatcttcccagtttttgacaaatatattagatttcacaatttacttgggtttttgtgtaaaaagataattgtgtttttctaatttatgaacatttattaaataaacaaataaagcagaaaaaaatggattgtgaggatttggcgatcatggatggatagtcttttgacatgtcatcaagtgttcacatggtaagcacacctctgtaatgagttaaaggatgctataaaaaacaaaaggatttactggcatatgagaaatactagcaacacactaacattttctttccaacaaactctttataaggtagaattcatgttggtcccactaaatatgttggtcacatccccaaactagtagaactcacatgcagttcaactaatatgagagagtcttaagaagaaagtattagagaatatattgctagtttttttttttttttttacagccaataaaaagagattatattaaaaaaaaggtacaaggggtaccctaacccacatacaaatttgcataacagggccaaacaaaaagccaatcaaattgcacaagatattatcccttcccatcccaacgatcagcaataaatacccatctataagattccccaacattaaatgtctcattcaattatcatagcgttaacattgcagcccacaaaaacccaaggagaatacattgctagtattcctcattggtatattatgtaaagtttaaggattaattgagacaagtttaaagttggtggtagcaatttgaagaagatcaaacataaatgttatttacttaccacattgaaaagcattacctagaaaacaacaagcatgatttccaagtgccagcttggaggttgtacgcggggggaattgccccttccttttgtacattatttttttttgcttcaacacaaaaacatgtacagtaatagtatagttccttggatgcagctcattgtagaatttgccagggaaagactttgtgtacataattgttctagtgagaacctaatggctttatcatctaaggaaaagatcttaagttcaaagaaactaaccacagattgattgcttggaacatcttcatctgctacaagcaattcacccctgcttccattggttactatagctccctctgctgttccagaactctgattttttattgcgcaaaccttcttagcagcttcttgcagagctctcatggcaacatgatagatttggattgattttgcaccttcttcaacatatttgattgcttcttggcgtaaattgttataacaaactgttacagactcacgagaagtacttggcaattcagatgcatgttcatctaacaatgtaccggttttagcattccttgtccagcgtgtcaatacatactgagatggaagagtaagaacatttttagctctgaagactgacagtatatgcctacaaataattcctgaatattcaaacatctgacaactgcaactagctttcgtctcaaaagaattaaaagtcacaacatgagatttttggttttccccaaatttggcaactcgatatgtagtgattgtttctgaatcatcaatttttgtagcaggatttgcaagagtctctactaactcctcttggaatttcatgaatatctttctcgtgtaaagacccgcagcttgtttttccataggagatggtgtttttaaaactggactactattagtagtgtcataatctgcttttaattctctttcatgccaacttgacacagctttctcgtattgtctaaccaatacctgtagagtggtggatgaattcacatatccatcaaagaaagaattcaaatattcattttcctcattcaaagatatctctccaaagaaagtctcccgcaagtacacatgaacccaatgttgtcgtgcgctgtacattgactgaagccattcattgtccatgacgtagaatctttccaagagtgagtgccaataagactcaaactcatcaatagtctcactttcttgaacgcatttcttgaattcagtttcaaaagcaggatgtgactgacataaatgagccagtttgcctcgggtttctctgaatatgctccatttacaaaaccgatggcgagttgaagggagaacttgggcaacagcaacttgtatgaaagggtccaaatctgttgtaatagagacagggtggccgccagacatggcatgaagccaagtcctgaatagccatataaatgacaattcagattcattgaaaatcaatgcgcaaccaaataacacaggttgcccatgatgattcaacccagtgaaagaggtaaatggaacccggcatcggttagtcttgtaggttgtgtccaatataacagcatctccaaaataagagtagtttgttctagatgttgcatcagcccaaaatatattcccacacgcgagattattgtcatcctggactgcataaaagaaagcaggattatctgcctgcatgcgcttcaagtagtccaatacatgatgacccccaccaccaagggtacgctgtctagtgatactcatttgtgctgtaagggacgaggggaattatgatcaggattataccaaatatggtgggttgacatgttacagagtcaacctacctaaattttttaaacaaaatccataaattaatgctgaaaaggtaatcaattgagaacttcaaactcataagtcataatgaaatggcaaagattctgtgaccctgctatgtctaactaatcccattacgttagagacgaatgtgaagaacaatactatatttttaatgactaatgcaatgatattactataaagcagattatcaacttacatagaactcacatagataacacaattagccagacatatataggttcaatataagctgggcctcatttttttttaaagaaaaaaattatagttaaaatctacaacatgtgatatacagatgcagcttacaacccctttctatgaacacgaaaactctaatatactaaataatcaacaacataaataattttctgaaatatttcttctgtacgcgaagaaccaataattggagcaactaaacaagaacaagtaaacagcccagaaattattatttaaaaattacggtcacagcggctgttgggggtggagtcgcgacggtgcaagctcgcaaatgggtgacaagaggtagcgtcccgaccaagtgactgactgcggtggcgtcgtgggcgtctgctggatgtgctcgcgatagctttctttcttaacggctgaccgcccggtggctgagagagcaaggcgtgagggagggggagagggagagttgggacttgggaggaggtcgtgcggctgaactgagttgacaactgtgaggtccgggaaaggtaaaggatgtgttttatttgatttgatctgatttgagcaattttgattatgattattaatgaaacaaagacactcgactcccacttgaaagtcacttatatatatagtttgaatgtaacttatttaaaaaaaatgtaattattatcgttgaaagttaaaataaaatattatgataataaattgagaataaaaacatccaaaaaaagatgacatcaaatataattatttcatttataataattataaattagggtatgaaaagatgaaggggatacatattatttaaacaaaggttttttatattgtcaaatttattaagaagggtaaataaacattatgatgttgaatttgtaaatttgtgataatttaatttatgaaaaatcaaaatttaaatttagttaatgtgtgataattacacctcatttttagttttatgacttatgagaccatttttgtcattaagcaatagttttaaaacaccaatttaatattaagttatattttttaatattaatttgaaattaagttaaaaaaataaaaattattttaagatgttctctctcctttatcgttgggatgaaaataggtcgaccacctataaggagctttgacctgacctgacctgacttgtttattataaagttcaggctaagactttttgaaaagtctgtttacataaaaaggtcatgcttaagcttttaaaaaaaatttttaggtctatcaggttgacctaattaatatatatatatatatatatattaaaacttaaaaataatatatttatttttctaaaaatataaatttccttattatgaaggtggatgatcaatcacttcaaaaatcaccttgaaaatcccataaaatgatcattacttatttgaaaatataagtaagatgttgagacattttctatttgaaaattgtttatttaactttcctaaattgatttaaagtgttttataaaattaattttcttattaaaaataggctttttaataggcttgtaggtcaaattaggcttttaaataggtcagaccaagcttaaaaaaaatcctatgacaggtaaataggttaggccaagctttatgtttttaaatcaggcctaaccaagtctggtcttgtctgacctgtttccacccctatttgtcgtggacacgagctaatcctgtgacctaaacctcatcatgatctcatgggaagagcttgtgtgtcaccaccaacttcttttcacaccaaattgtcaacgacatatcttcgattgtagaaaatcgtataacaaatccacaacatagtccctaacttccaattctcacgccatcaaaagtgaaatcctcaagttccaagaatcaaaatatccctcttgttttagaaccaccaacctccctccacaaattctctttgcaaaccttaagcaaaaatcactagctaaatcaaattcctttccaaaacactctatgacaccatttcaacacccttctttaccgtcatcttctcaatgcaaaatcgttttaacaattccaaaaagaaaccccaaatagagagaaaaggtgtaggatttggttaaggttacaatgttgacaaccagccaattgaaatgggttgggtatgccatgcggaacatgagccaaaaaagaaagtgttggtttggtgttttttttttttttgtctttttttctttcaaaaatgggtattgttagatgtggatggaaggtttggggaagaagatgggaccagtgaacgttaagtagcttttgatgaggaagataaattttaaaatattaataaaagagcatgtggcggccaaaaattgtcattatatgtaaattgattataataaatttaaatataatgacattttttagccttctttcgggtggttggatgttcttgatttttgattttcaaatggatttttcaatacaaaacgtgtttaacaaaaataaagttgaaataatttttaactcattttcaaaacacttttacattcattttgaaaatcaagatttttttttttgtgaatttgatttttagtttaaaaaaaaaatacaccttctttgcatttggcaatgactttttctattgccaccatcatcatcattgacactattatttggaacaccctaaaatcttttccataagattgataaacacccaagtattatttgatcattaaatcattcttgacttttcaaacaatagtttgatgaaatataattcaaatcaattgttacatagaggatatacaattaagaacatattccaaagaaatttaaaaaaaaaggattgcacattaaacacttgtgtatgaccatccaaagacttgtaacaaagcaaagacaaagcttgatttttcacaaattcaaaagtcttatatgttgtgccttattctttatttataagcttcaatgtgactattgtgggggaattaaaaatatatataactttttaagtacaaatcatcctcctaaagtgtacccgtgtataagagatgcatgggaatgcatcagtcaattcaggatcaacaacatttcttaggccttgatcttaaagaagtgacttcaacgaattgtaagggcttgatcgattagcaccttggcattccatcaaacaatcgaatggcctgtgtagaatgtaagggtgctaaaataactagtatgaattgaactgaactgaattgaaattaaactgaaacttaattatataaaactcaaactgaactatttggtaggttcggttttataaactgaactatgtagagaacaggtcaattcacaccacgttgaactgttttgaacttttgatattataaaagaattagaaaacgacgttgtagtttatgatgtttattacttggaatcataaaatttgaagtcaggagagacacccattgaatttgcagaaacgtaacagatcattgttctagattgtatggaatatgcaatgctagcatgtacatagtgtctaggttttgcttcaagcctttgaaacaatatttattatttcaatggatgcatgtcagttatttttgacatccagtcttaatgtatttggtctagcttggatgatacctttcagattcaatgctgttgtaacttgtaaggtattttacctgcaattgctcacttattcaaaatttctcttagtttttattatgcaattgaggttatgatagttataaaaattgaaactgaatattagatgctttatttcacagcatataggtttgcattttgttgctgaaaaattggaacaaaataattaaaatgatgggggtgaaagaatgagagcgacaagagaaataggttgtacaaaaacttgaatattgttgatagagaattagagattgcttagaactaatgttgcatttttcaaagctattaaatcaaatatttcagttcaatattttaaattaaaattgttaactaagttgttattaagaactgaactatttttcttcagttcagttattaagaactatttttcaaattcaatttgggagaaaattgaaacaatgaccactcccactagaatgtctcaaaacgcttaactccgatcctttttttgtatgaccatgtaaaacattatggacaatttgattattatttgacattacattagctgtgaatatgtggagtttatatgtattactagtatttttttaaagtttctttatttattttaaacaaaactattatgagtttatttgtttaaatttatttattaaaaaatgcttattttaataaaataaaggattagacaaacacattataaaaaacaaaatttcaaatccaatccggttgtctaggttgggtcggatctaaaggacctaaaccatacatccgggtacccgtgcgtttaccatgtggtacatgttgcctggttagcttacaattccttattacgcaaacgtaggttcaggaggcagaggctctcaaccagcaaatgacggagttatgcttatatagcgcttcatccacgctaattcccaaatctccagccgataggataatgaatctgtgaacggactgggacgagatttcagttattttcctcgatcagtgatattattatgtgagcaaattctatgatcttgtttttttttttttccttcatcgccgagacgaaaatgtccgcatcgcaatctcttggaggtccttcccgctgcggcagagttgtcggtccatcactggacaagataatcaagaacgccgcctggcgtaagcactctcaccttgtctccacctgtaaatccacccttgacaagcttgaatccctctctgagtcctccgaaccgtctccaggcgacacccaatcccctattccaggtctttcctcctcagatgccgactgtgtccttcaacctctctttcttgcgcttgactctgcctaccccaaggttgttgagcctgctcttgaatgtacctttaaattgttctctcttggccttgtctgcggggagatcaatcgccctgataactcgagtgcttcacagtccggcgttgtcttcaatatgattgatgctatctgtaagtcgggtggccttggggaggaggcgattgagctgggcgtgctcagagtcttcctctcagctgtaagatccccctgcattttgatccgggcagattgtctcattcaaattgtgagaacttgttacaatgtgtacctcgggggggtcaacggcactaatcagatctgtgctaaatcggttcttgctcagatcatgaccattgtcttcaccagagtcgaggaagactccatggatgtctttgttaaacgggtttctgttagtgaacttttggaattcaccgataagaatttgaacgagggcaattccatacacttttgccaaaattttatcaacgagataatggaggccagtgagggttttcctctcaaaccatcgtctatatcacctcctctggaagtgcagaatgtccacacaccttcgcccaaagcagcggatgaaacaggtaccgacaagttcgataatgaagctggagctgatggaagtaaaataagggaggatgggtttctactttttaagaatttgtgcaaactgtctatgaaattctcatctcaacagcaccctgacgatcgtatcctcttgagagggaaaattttgtccttggagctccttaaggtagtcatggatactggtggttcaatatggcgcgggaatgagaggcaagtagtataatacttactattcctgtacaaccactatttgtagaatgtaatgtaataattcacgcattatgaacttttattctattcaagggctttttgaagtgagactttcaattttgtagagaaactagtgaatttcaattacttgcatttttcgttgagttttgaactttgaactcctggtttgttttgttgtagatgcttccactcaaacccgtttaaaagtcaaacagttatttatgtgtccaccattcccttctttagttaacaggatcaaggcaaacaatttggtgcaaatttgcagcccttaaactgtaaggtcactatttttttctttgaaacagtgtttctgagcttcttggagaatgtttggtgtgtcctctactttggaacaaatttggtaaattaaaacgagaccttaaagtttggttgaggatgtcatttagatagtcctttggtgtgtttggttgtagtggaatgctcatatctcttaggaaatctctttgcccttgaacttgtaagatgatgggcttatatttatggtttttgtttactcatatctgcttcaagagaactgcaatttcttatgtaaagagaaacagctcagccttgctacagttttttttttttattattttttttttatcttgttgagcggtaaagttgtgccttggtgacttgttggtcatgggttcgaattcggaaacagcccctttgcatatgtaagagtaagtctacatacaatatccctcccctttatcttcgcatagcgaggagcctttgggcaatgaggtaggtagttttgagggcgagccctgacataccggtaaagttgaactttggtgacttgttggtcatgggttcgaatccggaacaacctctttgcatatgcaagggtaagactgcacacaatgttcctcccccttaccttcacatagcgaggagcctctaggtaatggtgtacgtggttttgagggcaagccctgacacaacggtaaagttgtgccttggtaacttgtggtcatgggttcgaatctggaaacaacctctttgcatatgcaagggtaagactgcgtacaatatcgctcccccttacctgcgcatagcgaggagcccttgcgcaatggggtacgcagtttagaaggcgagccctgatacaacggtaaaattgagccttggtgacttattggtcatgggttcgaatccggaaacagcctctttgcatatgtaagggtaaggctgtgtacaatatccctcccccttaccttcacatagcgaggagcctttgggcaatgaggtacgtggttttgagtgcgagccctgacacaacggtaaagttgtgccttggtaacttgttggtcatgagatcaaatcaggaaacagcttttttgcatatgcaagggtaagactgtgtactatatccctccctcttattttcgcatatcgaggagtctctcagcaatggggtatgtaaattatttttttttgtatcaagaactttcttttcagggggtatcttatcctaccctagttatattctcttttttctctcaaataaaattgctttttcaataaaaaaataattatgtactgtttttaggagttaagtagctaatatgcaacatttttttattataaggaggtgacaagtttattaaacatataatgtgataatacacataaatctacctactagcctgcccataactttttttattatttgttggttcaatttaagttgaagaagttttggatgtaacttgtttcagctacttcttttttaaatctctatatgatggcctctttgctacgtgtggtgttttaaagaatatttcttgtatatcatgttcttcatattgcttctttgtttatctgctctttttatttcaagaaataaatagacgatcctttgattttttggtggggttgtatactagttatcggagttagagaattctcaaatttatgacccatcaatgttttcaattgatatccctttttatacataaaaaagatcttttttatttttatttttatgtataaacataagatggatgattgtatatggtcttaaaacaaaggcatttcattaaccacacaatacattaaccactaggttctgctacatggaccaaacaacaccattgtattttctcaaaatcctagcctttagagaggtcatttagatccaagttctttctagttgttttgcttttttttactttgccttcctctacttgctatcctccatctgatcaactcttcttagtaggccttttattggttttcttcgctcatggacaattgtcaaaccatcttttttctctacatatagttgttgatagtgtgatataatcatgctatcatgttgatgcatagcatcatgggagctgataattatggctagcctgtcagtgttttcatggagtgacaattccagataagatcaagcatgctttgttgtcgtatcaaccattagtccatcacactaacgatgggctaaaatcccactttgccgaccctctttcttcattttcctgatgtaatactgtgacaagcaggatgtttcccctggttaagtccagaagcataatattgagccatgacattggttagctttgcactcatatggttgaaataattgtttcaagaattaagttttggagaaataaagcatatgcaatgtgactaatatgtgaagtcaaacaacctttaaatttcctcgaatacagttttacatgaagcaacaaagcacataaagatgggcttccacttcatgcaagattttgtctagttttatggcactactagccttggaaatttgaataaacatgttggaaataggagtatattaggagataagagcctctttattgtttatttttccaagtagcctagatacttggtatagctaggttcattgcatcttagaaagtcgtgctgtagtggtactttaatattctcttgtaaattgttttggcattaattaacttttcttgaatataaataagtccattctgttggccggagaaaatactcaacctcaagcacattcagaaaattttcctttctcattttctcacaaaataagtaatagatgtgtttgttaattctcttgagggtctttggatttgctacattttgtaatagcttggttcatatggtttatatgatctaacttgaggtggagtgtaaaaatagtaggttatagaatatacttctctctttgcgttcaatgacattgacttacacatatgtataaaggttctttccctaagatctttattttccattttattgttaataatttatcatgacacctatattgcttttacacggtgcaggtttctcaatgccatcaagcaatatctttgcttgtcattattgaagaacagtgccctgtcagcgatggccatttttcaacttcagtgttccattttcatgaacttgttatcaaaattcagatcaggcttgaaaaaagaaattggcatgttctttcccatgcttatccttcgagttctcgagaatgttcttcagcctagttttctgcaaaaaatgaccatccttaatttattggacaaaatatctcaagatcctcagattattattgacatttttgtcaactatgattgtgatgtggatgcttcaaacatatttgaaaggtatcttgcttttgtaatattttgttgctcttataccttggtagtggtcagttttcaagaacaaacatgggctaatattttaaaaagcaaaggtgataaataattttgtttgccaaaaaaaaatgatgaataaccttgttaatgcaaaatcattggattcttttttttcatttattgatagaaaaaaaggatgccttctagggtggtggatagtggttgactaactttaagcctagggagtgtcctggaattgtatgaaatgtagatttagatttggcttttgtggcggaggttttgggtgggtgtggttggtgtcaaattaggattgttgaaatactttattaaggatttggaagattaaaattagttctgttagtaataaagtataaaggaggaggattgtgcacttgtgctaggccctcgacaactaacataaaacatggatcactcacataagattttagctaatgctaagtcgttaattggaaatatcgcactgtatgactcgagtacagtgtcaaatgagctatagtcgttgcattgatgtctgaatgtagtgttaaatgagtaagagtcctcacattttcctggatggatgtgtgtgaagaagctagtttagaggtgcttgattaggtttgctacttggaaattgtaagtctatggaggtggatattggataccatgatttggaggaggattaacattatgtacctacaagagatcaagtgggttagagaaaaaagctaaggagctagataccacaggatttaaactaatacatgggaaaagttagaggaataaatggtaggctattattgtaggcaaggatttgaaagatagcgtggtggatttaaaaagaattggggacaaaatcttatccttaaaattagttgtggcataggagatcatcaatatcattagtgcttatacaccacaagtaggattggaggcacttatggaagaaaagtcttgggaagatatggaggggttggtacaaggcgttccataagaggaaaatattttcttaggcaaggatctaagtggatatgaggaaaagattttcttaggcaaggatctaagtggatatgttggtcgtgaggcaagtcaattttcaggagctcatattggtttgggttttggaggactaaatgaggaaggacaaactatttttgatttctttacgacttatgattttagattatgaaaacttgtttcaagaagctagaggaacatctaatcacttataagagtggaggttcaatgtcactgttgaaataagagaaaacaaagggatagttgagtgaaaactgtgtgtttgaatacatagcggaggcttgtttatttaggtttaatacattgattttacataaatagaggacatgttgtttcctctaaatcaaagattatgtgcctataaatcagtattatttatagagtcacaatattatattctgattttcaacactcatgttaaaataggagaaacaaaggaaaattgattgaaaaccatgtgttagagtacacaaccaatgctctattctatagtggtcattacaataaatactaacaatgagaggatattttgtttcctcaaaaccaaattctagtttcctacaaatcctactttcctactaataataaatgtatattatattctgattttcaacactcgccctcaagctaagcttactaagctctcatcatgttacaagaaaataaattattcccaataaatcaataaaatacacaaaattaagctccacctaagaacaatagtttgaaaagcaactcagggatgttgagaagatcgagataattgctagaaaaaaaaatctttgctagataagctggaaggaatgaccatcagtgagaaaattcgtggcaagcaaagcaaggttccttcttcttgaaaccacatttaaaagcttcaaaccaaaaaggttggagaccctaattatttaaactgaaggcgagatagatgcatctggggcaaagtcgttgggacaagtgcatttgggacataggcgggatcagtgcatctgggacataggcaggatcggtgtatctgggacaaagacaagggccaatacatctaggataaagacaaggccagtgcatttgaatataggaaaaaaaggaatgtcgaggaaacactcatggaataaaccgaaaaggattgggtcttgtgcgccttattttagagagcctagtgttgcaaacgacgtccggaaggtggccagatgcgctgaccttagttgctgttaggtgcgcaaagaacgtacgcgtctgtgcatctttggggatgtgtttggtgcaggcaaacagatctggggaaagtgcaccccgaggatgtactggccgacaaaaaacttgtcgaaaaaatggtcaatgaacagtggctgtcgaaaaagtgacggcgaccggaggttagaaagatcgctcgaaaaaggtgcggcaagtagaagggtccaccagggacccattgtccccggtgaggcattgttttcgtgatacccctgttaggctctggataccattttgaaataggagaaaacaaagggacagttgagtgaaaatcgtgtgtttgaatgtttatgtaggtttgattatacataaacagaggttaaccaagtttggttctgaactttgtatagatctattgatggggctttgcagtatgccactattaccagaccagaaattagattggattttctgttaacaaggtttgcccgttcatgtccaagccttctgagcagcactggatggctgtgaaaagaattctgaggtatctaaaagggactgtgtcttggggattaaaatttcaagctggttctcctaggcttcctttctctcttcatgcctattgtgctgcagattgggcatctgatcctgatgacagaaggtcaacttggagcagctatttttacttgaacctaatctcatttcctggtggtctaagaagcaatcagttgtagctagatcgagcactgaggcagaatacaggagcatggctcttattacagcagaggtaacttggattcagtctctgcttctgaactccaagttgctcataccgctcctctcattctctgtgataataccagcactgtctctcttgctcacaaccctgttcttcattctcgaactaaacatttggagcttgatctgttctttgttgggaagaaggtcatcaccaaacagattgatgttattcatgtgcctgcagcagatcaacttgctgatattctgaccaaggccctctctcctgcttcatttgttccattcagatccaagctcatagtagttgaaagaatttcttccaatccctcgtgagcttgcaggggggtataagagtattacatttactcaaatgtatttttttctttatttcagtaagctgttagtctaactaccattgttagtagttagtttgtgattagaggtcattagtgtgtaaccgctagtgacagctgtatcaactaacttaggttagttgactgttaggttgttagttgttagatcatctatataatctgtaactgtaatcagttatgacttgggttgaataacattagatttctcaatctcattctcttctcttctctcatattcactcaactctattaatttggaatgggacgtctaagaagatttggaagcttgcctgaggagtcctgagtgaattaaaaggttttggaccaagataaagaatgttggtggtggaatgaaagttttcaagactaggtaagaaacaaaagagtttgctttaaaaaccttacatgagtgcaataatgcagaaaattgggcaaggtatcaaaatactagaaatgagataagaaaaactgtgagtaaaacatgatctaaagctttaaaaggcttttgtgcaaggtggtgtcttagaggagtaatataaaactattcatttgtctaaaccttaacagcttaagattttggaattgttagtttgtaacaagttctgataaaaaatttagttatttggagtagatcgtcatgttggaggccataccttgggttttaggatcataattgtttccttgcttctttattgattcgttttcttatatggtgtacttggagcactgtctgcttccaaaagttaaagcttattcaaggtctgcagtacaaatctagtgacagattttttatttacttatgtttgtttgattttgcatcttgttttagtatttaaacacttataattctatcagatatttgcaggattgtcaatggtcttctgaaaaccgctttgggaccacctacagggtcgaccactgctttgtctccagcacaggatattactttccgacatgaatctgtgaaatgcttggtcagcattgttaagtcaatgggagcatggatggaccagcagataaggttaggagatttaggcccagcaaagagccctgaaagcagtaatgcagcagagaatcatctaatactaaatgtagaagaaggaaatgcttctgatcacgagctacattctgatgtaaattctgaattttcggatgctgccacgtttgagcaacgtcgggcatataaaatcgaacttcaggtatgtattacttggctccgaggacgacaaattgttatattgtcacaatgttaacggtaaaatatgtttttggtcccactaaaattttgaaagttcggtttaagtccctctaaatttttttgtccgtatttggtgcctctaattttgaaatgcaccacttttggtcctccaagtgctatctacatttcttttcatctctctgtaaagtgtcatctaaaccacttggaggaccaaaagtggtgcatttcaaaattagaaggaccaaaaacagacaaaaaaatttagagggactaaaaccaaactcttaaaattttagaggaaccaaaatcataatttaccctaatgttaaactatcctcttatactagcataacattgagttctaattgtttgattttacctacccaaaaacctatattgtgtttgtacaattctcttctgtatctctccttctgctcccatgaattgcatttatacataattttgtcttcctgagctgcaaattttcatattctatgctgatgcttttttttttttttttttttttttttctgggttaaatgcagaaagccatatcactttttaatcgaaaacctccaaaaggtattgaatttttgataagcaacaaaaaaattggttgttctccagaacaagtggcactgttcctgaagaacactgctggccttgatgaaaccaagattggtgactatttgggagaaagggaggagttttctctaaaagttatgcatgcttatgtagattcctttaacttcaaagggatggattttggtgaagctattcgattttttcttcagggcttcaggttgcctggtgaggcacaaaaaattgatcgcatcatggagaagtttgctgagcgctactgtaaatgcaaccctagttcttttagcagtgcagatactgcctacgttcttgcttactctgtgataatgcttaatacagatgctcataataatatggtgaaagataaggtttgaccttgctgaatcttttatattatgtcttaggctcaacagttagagtaccagctttgtgacattacttgatgtccaatctaggtgtggtttcgtttctattaggcttaattgatttttttaatagttggtacatcatattttactgatgaaatttgaatatgataattttaatcatagaaaattatcctataaaggcaatttgatttatgcgtatttattctgaatacagctttgaaaatatcaattattttctctttccatttcttttatcttcttatgtaggtggtggtagttatggtaaatcatagctttgtgtcagggaaacacagtgaacaccatgagctataacatcaacatgtaatatcattttgtaaatgatttggatatcatttgattgcttatatttgttctattgttttacaaaattgagattgtaagttcagaatatcttacaatgctgaatataggtttgacctgaatttgtggtgtatattctatgttaatggatttccagatgacaaaggctgattttgttcgaaacaaccgtggaatagatgatggaaaggatttaccagaggaatatctcggggcactttatgaccaaattgttaaaaatgaaattaaaatgaacgctgattcttctgcacctcagaataaacaagctaatagcttcaatagattgctgagattagaaggtatactcaatcttgtgaactggaagcagaatgaggaaaaagcagtgggtgcaaatgggcttctcattcagcacattcaggagcaatttaaaactaattcgcgaaaatcagagtaagccaagacatttctcaatgtttggatttttattttaggcttaaatataatttgggtatcttaaatttaggcctaatttccttttggttacccaaatttaaaagtgtttttttttcattcccctaatttggaaatagcccacttttggtccttatcacggagactaaaatgattgcaaaaaataaccttaagggccaaaagagggctattttcaaagtagggaacaaaaataatcatttttaatttgggaaaccaaaaggacaagaaatttggctcaaatttgaggaaccaaaaaaatatttaagcattatttttttatcattaattttttttggaaatgtatttggttgcaaaactagacctgctaagctctttcttttccacaattttttgtatataggctttgatttggctggctctgctacttgatatctttcaatggattttttttatctaacatttttgagaggattcagaaggtttagttaaaggaattttgaaatgagtaaagattttcctaggagggtgagccctaacacaacagtaaagttgtaccttagtgacttgttggtcatggattcgaatccggaaatagcctctttgcagatgcaagggtaaggctgcgtacaatatccctcccccttaccttcgcatagcgaggagctctgggcaatggggtacgtagttttttgttttttttttttaagattttcctaggagatgatctagttggtcacatgaatgattgtctagagtatagtagagggtaaaacatttctagattttgctttagctaacacttgttttaggtaatgggaagaacatcatatcacatactaaagtaaggtgacatgcttccaaaattgtttttttttccctctaattaggaaatcagatagaaacttttgcatggattgcaaagtcatacttggagaatacttgtttatccagcataggatcttggttatggatatataactcaagaggagagtaaatagaaatggttaagataggatttcaaggataaaatggtagcaattgaagggaaaaaaggagttttgaaagaagtgagggagggtttttggaggacatcggtcaaattatataccatgaggtatgaaaagggtgtaggagcataaaatggctcattgagttgtttaacaagattatgagattggagataatactaaatgagtagagaagtgccttattctctatattttttttttttttttgatcggcaaagataaagtataatattaatattagggcaaaagatacaagtataaaaacaaaaacaagtccatgctagcaaaaaccatagctatggtagcctaatacatagaaggcctgaattagaatatcatagcgaggatggacaaagccccccatacaagtatgataataaccttccctatacacgaaacatatccctagtattagatgaccatacatgaaacggcaagtaaaagcctttatccaaatttttacaccaccaccagcaaaagaagagggcatcatcaaacagcctatggctatcaaaccccccgctttggaaaataatactatttctgtgaccccaaatagcccctatatatgagtatgagaacaagagtgacttctaaaactggtctagttatagaaatattaagctcatgagccatattatgaaactacaagatagggtaattaagcagtcattatagaaaatgaattttgttttatgtcggggaggttacccacgaaagcaaatatacttccttcaaagattaatggaaaaacattggaggaattaatggagagacattagaggaattaaaaggacaattcatcaatttggaaaaaccatatggtggggtacgaagagaggtattgtccttcgcttaggaaatgaaaggagtttgtcctgcttgtagtcgggcaaccaaagatatgtaagatggtttcaaattagagtgtgaacataaggtgaggcgcacaaaggactttcttataactattggactgcaccaagagtgagcgtcaaacctctatctttttaacttggtcttggatgttcttatttcttactgaacatatccatgaggcagatggcataatgcatgcattttgcagatgatatgccctggttggatagttgagagaagaaataaatgagaagcaatagaggaggagacaaactttggaagcttgacttttgtttaagtagaagggaaatgaagtatataaaatgttagtttagctagaggcgcactaattctagtatggacatgaaatttggagactataacataccacaagtcataggttctatagttcaagtttcttggtcatcatacaaatgatggggaaatgtaaaccatagaattcaagtgggatggatgaaatcaaggagtgctttaggtgttatttgtgataggaaagtaccactcaagcttaagggaaaatcttactacataactataagacttgtgatgttgggcaatgaaatccaacaaggagaaaagctcaatattgtagagatgagaatgttacgatgacatacagacaagtttgtgaatgaatgcattctagagaacattggggtagcacctattgttgaaaataaaatatggtagattcttgctttaggtggtttgagcatttgtagagaagacctatataagtcccaatagttagaggtagagaaaaactaagaaaagtcttagggaaaaccgttaagaaagatttagatttaaatagtttgtatattgatatgatatatgagaggattttaccttttgattcatgagagctggccccacccggtgggaaaaggctacaactattgttgtttattgtttatatatttatgattgtgtactggctctgcatcttagatcctttccatatgtgcattttccttttcctttaaggattagctatctgctggattatagattacataagggatgttaatctttcaatgcgtttcatagtttagagtttagacattttatttaccggttattgcagatctgcgtatcatgttgtcacagatgtggctatactgaggtttatggtggaagtttgttgggggcctatgctggctgcattcagtgtaacacttgatcagagtgatgacagggtagctacttctcaatgcttacaaggatttcgacatgctgtgcatgttactgcagtgatgggtctgcagactcaaagggatgcttttgttacatctgttgccaaatttacttatctgcactgtgctggagatatgaaacagaaaaatgttgatgctgtcaaggtaagtgaatcttaatttggatgccattgacattactcaaatcaaatcactcacctttattctccttttgcatttataatgataactgcttattgcacaccatatattaatgtcattttagccatattgtacttatatcaagaaagcagtgatgaatgggttcactttgattttatttgcttaatccttcgcatgaaaatagaatgtgattggtacatttttttgtgtttatcatgtgaatgaaccacttgatttcatgtatatgtcattttagtatcttttaaatcttatttttgtgcaggcaataatatcaattgcgattgaagatggagatcatctgtatgaagcatgggaacacatattaacttgcctctcccgaattgagcatttgcaactgttaggtgagggtgccccaagtgatgcaaccttcttcacttcagctaattttgaaatggaggagaaagcactgaaaacattaagtttctcttcttttaagaaaggaacactccagaatccagccatggtggctgttgtccgtggtagttcatatgacagtacaagtattggggtcaatgcttccgcaatattaacaacagaacagataaataatttcatttcaaacttgaatctactggaccagattggaaactttgaactgaaccatgtgtttgctcatagtcaacggttgaatggagaagcaatagtagcatttgttaaagcactttgtaaagtttccatttcagagttacagtctccaacagacccccgtgtatttggcctcactaaaatagtagaaattgcgtaagtttctttgtcctttttatgatagatgttttctttgtgcaattcattcagatttcttaaataataattttcttgacatatggagcttgcacaatgaatataaaccatgcaatttacactcagacattgcccattttgttttatattccttatttgtacttttcctagtgtgttttggtatgaatatgaaatatcctagtatatgaaattatgaatacatgaccccagcaattttttctcttcctcatattgaatatggtgttgacattgtcatatgttttaggcatttagcccaatgttgtggccaagcacgaaataaagtaatgccttgccctgctacataaaacctattgcttttgatatttatcttaagaaagtggctgttatagatggaaaaagtaagaattttaagataagttcaactattgataagctcaactattatcataactcataaggaattatatggatgtaacttggatgccaagtaacctggcagattgaaggtttaggtttttggtatgttcaatctcctcggtcccgtgtttgagtgttgtgatcttcttatgctgttatattttaaatcacaaaatggtcattcaaaagaaaggaatttcttgtgactatgagctacttggcaggcaaagctcttaaggactagcaaggtagggtgttttaggactttggcagatacatatggaacaagcttggcacatatgatatatagacaccggctggaggggagtgttagaatatcttggatatttatgagatatgttaagatatcatgtatgttggaaagccaccttagttggggtcacccctagcccaccttagttgtggtggttggtagccatgggcaaagaggggtgtgttgaagttccatactggctagagatagtgttgagatatagtatataagtagggagcaatcctcaccttacaagccggttttgtagggttgagttaggcccataatccactttctaagaatgtatctattatagaactggtaaggaatcaatttagataaaatcatcttttaattttgaaaaacatatactacatcttgagaatggttttatacatccaacatttcccaagaatcatttgaggttaaagcacaaaaaatgcacaagccaatttttccttttgctgaaattcaactttatttataaatgggagcttacaaggattgaactcctaactgattggtcctggaagctctaatatcatgtcaaggaacaactgtccaaaaagcttaaaatgttacatggtggatcaagaatggttttatgtctctaactctaacatatttatgttaattgttatatcttttagaatgagggaaatgttacttgcctgaaaggggatcctttgttgattttattagaccttaagaaagggattgtgattttctcttggtcatgttctttgtagctagtaattggtgattccaagttattctcttctcatgcacatttatgattaaaattctaatgatcattcaatctacttaagactagaacatggttgcatttgcaggcattataatatgaaccgcatcagattagtatggtctcgcatatggaatgttctctcagatttctttgtgtcggttggattgtcagaaaacttgtcagttgcaatctttgcaatggactcgctgcgacaacttgcaatgaaatttttggagcgtgaggagctggctaattataacttccagaatgaatttctgagaccatttgtgattgttatgcagaaaagcaacaccacagaaattagagaattaatagttcgttgtatttcacagatggtccttagccgtgtcagtaatgtgaaatctggctggaaaagtgtttttatggtaatgttgaagttggcttgatccccccccccccccctccatccctccctccctccttgagaccatttgataaacaacaaaaattgaaactgtcaaatgttgcccaattgtttttattgaagaaagcaaaacaaattgagaaggcacatttgtgattgtttactattcttttcaagaaaaaattacattttattacttgcatacacacatttgttggcaatttagatagtctaaacaatctttcaggaatgaatattcatggtcaaattttaatacctctaaaacggcttgttaaaaaggaaataaatacaaataaaaagaaaagaaaagggacatcaaggatacatatctagtcaaactattgatggttttcaacaatctaaatgcaatacacaagtttagtgtaccagcaaattgttaatataatgacatttaccaccatgttcagctatgggcttcattaatgtccccgcttccttcctaagcaagaagaaaatgcacatctcatttgttagcatttgtgaattgagacaatggaacaatcttgacttataatgcagtgtttttgactcaggtttttacagctgctgcagctgatgagcggaagaatattgtattactagcatttgagaccatggagaaaatagtgcgtgaattttttccttatattactgagacagagacaatgaccttcaccgattgtgtccgatgccttttgacatttaccaatagccgattcaacagtgacgttagcctcaatgcaattgcgtttcttcgtttctgtgcattcagacttgctgatggaggacttgtttgcaataagaagagcagtgttgatggcccatcaattgttgtagcaaatggtatttcagatttacaatctcatactgataacggtgatcatgtctccttttggaatcctttgctatcaggtaatatgcatttagatgatatgccctaagatatttggtacagtggccaacgtaccataacggtggaccaaaaaacttattcttgtgaatcttgtccaataaatgtatgtattctgtttaattgattgattgcataaatctcaaatgtctattgctcacattcctgttgaagctgccttttatatacagtatgttaagctttgtattaagtttttgcgttaaattcttgagcaatgattgttgcattttgtcaacagatttgcttgcacttctcttgttagatgtagcaaataagtggtacctttagctcctagttagtgtcaaaaaagcaaacgtaatagtgatttaaccacattttgtgcagcagtgagataacataaattccataactcttgtctgttctttctgctttaagttaatatttttatattttcattgcagggttatcaaaactaacttctgatccaagatcagctatcagaaagagttctttggaggtgctttttaacattttgaaggatcatggtcatctattctcccacacattttggaatagcattttctgttctgttattttccctgtatataactcggtatctggaaatagagagatgaatctacaaaaggcccattgttccccttcttcagtatctgtgcatactgaaggaagcacatgggattctgagacttattcagtagcagcagaatgtttaatagatttatttgtcaccttctttgatgtggtgaggtctcagctacctggcttggtgtcagtactgacagggttcattagaagtcctgttcagggtccagctagtactggagttgctggattagtgcgtctcacaggtgaccttggtaacaggctttcagcagaagaatggaaagagatttttctatgtttgaaagatgcagctatgtcaacagtgccaggattcatgaaggtcttgagaaccatgaataatattgaggtgcctcacatttcacattcttctgctgacttagaaagttcttctgatcatgacttgaacaatgatgaatttgatgatgacaatctgcaaacggccacatatgttgtgtcaagaacgaagaaccatattgctatgcagctacttattgtacaggtttatttcttgctcgttttgtatgtgcataagttaacaattaaaacataagcactaaatttcctagtattcaatttatatgcatccactgaatttaaatcgtaatccactgattttgttttattagttttttcatgaaaacagatttaaagacatgtgtagtgcagcttgatataaatttcacctctgaatgagttcatcttgatgatatctttctgtgttctattggcaggttacaactgatctgtacaaaaagcaccagcaatccttatctgcagccagcatcaaagtccttattgaattatattcatctattgctttacatgctcgtgagatgaacagagagtcaattctactgaggaagttgcagaaagcttgctctgtcctggaaatatctggccctcccatggttcattttgaaaatgagtccttccagaatcacctcaactttctacaaaatatacatcttcatgataattttgtgcatgatgagatagagctagaacaagagttagttgctgtgtgtgaaaccgtattggacatatacctaaattgtgctggttccatttccacttttcacaagtctgataccatgccagcgcctcatggaaaactccctctgagctcagcaaagaaggaagagatagctgctaggacatctttagtcatctcagcattgcaaggattggctggtctgaaaaaggattcattcaggaggtatattccacggttctttcacttactggtagatctcgtgaggagtgaacacacctctggagaagttcaacatgccctgagtaatatgttccgttcatctgttggccaaattataatggactgagttttagttttggcatactttgtttttggacgttgctgaatatcaatcagcattttccttataagctaaagaacgagccattacatggtcatatcttgatttactcaccattgttgtgtagtgttactcttggttttttgtgattgtatgtgccattaatgtaaatgataaatttatttcaagcagaatatggaagtaccacagatagatagcgaagagacttaggcagccgctggcagtctacaacttggcctgacttgttccttttcaacaatggagattgagtcatagtggaaggagatagtttctcttaaggaaccaaaaaagtagtcttgttccttttcagatgatgtttaaggttgtgacataagaattaagatatataattaatattctttttttaagattgttacatgatttcttattatattatttatttatcttattgattaattttctacaatttattttttattgatctgtttaattccatgataaatgggtaagataattttaaaatatagataaatataaggatataattaataaaagagtaaggaaagttttgaacttttaaaatgagataaaaatgaacaaaaaaaaaattcttaataaaattgacacttgaaaaagggtagtatttgtcaaaaaggataatatttaagtaatttaaaattcttttaaattaaatagagtctattcgaatatattattgttattattgttatttgcttaactgttaccttcaggcaatgattaaaaactcaatttttttatatatatatatttttatttagaagtgtatctcttggtaccaaaaggcttccaagtttgttatcctaaggaaacttacctttctttttcttgtgtattgggcgaatggttttgagtataaacatgtatatttggtcgttttaatgatttaaaaattcctgaactaatatattgttggtaatgactgttgtatttatgtgcattatggtgatttaaaatgtttttttttttttttttttacgttggtgatttaaaatgttttaggggtaaaaatcactaaaaattcttacataatgaattttatttgcgttaatactttgatgactcttatactaatcgcgagtgattgagtttataacttttaaaattttaataaaaaattgtggcaattttagtgaatatcatttttaaattagttattttaaaatttaaaatcctacccatgttagtatcttaatgatcaaaatggattcattcataaacataaaggaggaaagcgtgatcgatcaaaattcttcattcaactagtcacattcttatttcattttacaattataatttgtgtaatttttttatagtcacaggtattaaattcttttttcgatttcaaagtattaaaaaaaatcaattattataataataagtaatatcaaatatttaaaattatgtgaataaagaataaaaaatagtaaaatacataactatcaagcaaccgtaagtataaataaaaaactttaaatacaattgtgtttcccatttttaaaaatattttgactccgttgatacaattttaaagaggagggaatctagcatttaaattccattatcacttatcaatatttgaatgatatggttttttatataaaaaaataaaattggttaaatatctttatgttttgttttgagaggagagcaataagtttatggtgagagagaaaaatatcggcatttcctcattctgcagtttggttggagttgtataatctctttgttgtccggcgcggacttcttactgtcactcgacctcgacctcgacctcgacgacggtcagttgttttcttttccatatctcgtggctttgctttcgtttcgtagtagtgtatatcctgaatcctgatcgcagaaatagtattagtaattgggatataaataaattaattagtgatggataacgaggtggaggtgctagaatttgatattgggctgggaggaggcgagggagaatatgacgatgacgacggaggaggaattgatgaggaggaattggctgtagccactggaggtggggaaatatatcttcctgagggggacctcttagatcttgaaccttgcgagggcatggaattcgagtctgaagaggctgccaaggccttctacaattcctatgcccgtcgtgttgggtttagtactcgcgtcagctcatcccgtcgttccaggcgcgatggagctattatacagaggcaatttgtttgcgcaaaggagggtttccgcaacttgaatgagaaacgcacaaaggatagagagatcaagcgcccacgtacaattacccgagtcggttgtaaagcctctctttctgtcaaaatgcaagactctggcaagtggatcgtctctggctttgttagagaacataatcacgaactcgttccaccagaccaggtgcattgccttcgctctcacaggcaaatttcaggatctgccaagacgcttatcgatactttacaggctgctgggatgggccctcgtagaattatgtctgcacttattaaagagtatggtgggattagcaaagtcggcttcacagaggtggactgtaggaattacatgaggaataataggctgagaagtttagaaggtgacattcaacttgttcttgattatttgagacagatgcatgccgaaaaccctaatttcttctatgctgtgcaaggagatgaggatcagtccatgaccaatgttttctgggctgatcccaaggctaggatgaattatacattttttggtgatactgtaacctttgacaccacataccgatctaataggtatcggttaccatttgctccctttactggtgtaaaccatcatgggcaacctgttctctttggttgtgctttcctaattaacgaatctgaagcatcatttgtgtggcttttcaagacatggcttatggccatgtctggacatccgccagtgtcaataacaactgatcatgattctgtaattcggtcagccataatacaagtcttccccgagacccgccaccgtttctgcaagtggcacatctttaaaaaatgccaggagaagttatctcatattttcctccaatatccaaattttgaagcagaatttcacaaatgtgttaacttgactgagtcgactgaggaatttgagtcttgctggtcaacacttgtagataaatatgatctcagggaccatgaatggcttcaagcaatatattcttcttgtaggcagtgggtacctgtatatttgcgagacacattctttgcagaaatgtccatcactcagcgaagtgatagcatgaactcttactttgatgggtatataaatgcttcaaccaatttaagtcagttctttaagctctatgagaaagcacttgaaagtcgcaatgagaaagaagtgagagcggattatgacacaatgaatactttgccggtattgagaaccccatctccaatggagaagcaagcatctgaactttacacgagaaaaattttcatgaggttccaggaggagttagttgggacacttacattaatggcatccaaagctgatgatgatggggaggtcattacatatcatgtagctaaatttggagaggaccataaagggtattgtgttaaattcaatgttctggagatgaaagcgacttgcagttgccaaatgtttgagttttcaggccttctttgtaggcacgttttggcagtctttagagttaccaatgtgcttactctcccatctcattatatactgaaacgttggacaagaaatgccaaaagcaatgtaatattagaagaacatgcttgtgatatatatacttactatttggaatctcatacagttagatataacaccctccggcatgaggcttttaaatttgttgatgaaggcgcgcggtctgttgaaacttatgatgttgcaatggatgctttacaagaagctgcaaaaagagtttctcagggaatgcaaaatgagggaaaaattcctatcagtaatggaaaggtaaggagtcatgtgctgaacgaggaaattcatgctaattacacaagtgggtgccaggaagaaagcttgagccagcatatgtctaaggtctgatttccatttgaaaaatgtttttaatctcttttatgatatctgtttgagtgcatttactctttcatccaccgttatatgaaaccaatcccgaaccttcacctaatagcttaaggcattatgatataaaccttgacggcttcacctaaaaccaatcttgaaatcgtaccagagctgctatgaccaagtagttaggagtttgatccctgccactttcattcttataaataaagtttaattctgtcacaagatagagaaaacctgtgcaatggccttgtctcaagccctaaggaattggtgtgagggggttagagatatataactagtcttgaaccttcatctaaccgcataagattttgagaaagttgattgttggcacaccctttttagctctcaaggtaaggctagttactttttactcttaatccttcaataacctttagttattatgagtgcttttgtagatttactgtatttaagtccagatacatacatacatatatatatatatatatatatatatatatatataatcatttgtggtattttaaataaagctctgtttccattccttgattcaaatatgaattacaggtcaaagtaataatgaagactgtacactaatttaggagtctaaattggaaacagctaaacctaacaatgaaataatctgaacagattagaatcaggagggattttatatacaaatattaatgatgttgaaagatatatagaaacttcgttactgtttcattttcttaaatttagggggatttattattcttcccctagatgtactttctcttatttctttcaaatattatattctttctgaagaaagaaaacatttattgtgtaacagattttatatcattggttttaaatatataatcattcatgcttaagtatgcttttgtttattttagtttcattgctttatgtcctgcaggatgatttggataagaatattagaaaacttatgaatgagcttgagtgtgcaaatcggaagtgtgaaatttatcgctccaacctgctttcagttttgaaagctgttgaggatcacaagttagagttgtcagttaaggtggaaaacatcaagataagcatgaaagatggcatctaaagactatggagaattaaaattgaaacagataggaaaacaaattctattttggcaatccagtcgcgcatcaataatgatcccatgacaacccgccgccccacaattgtcttgtagacctcttattatgtataaagttggtttgcagtgtattatttttttgttcagtactgtatttattatattgatgtcaacttttatagtccaagtttgctttaagaaaataataatgtagcacttatacgtcatcgtattaatatttttctgagtttaataattgcttacatagttttttcttttttaaggaattgcttacataatttttaacccgcagaaaatgaactatttgatttgcataaagtccaagtgtttcaacaactatttacaattttttaataccatatgaagaaaatattaaatgaaaaataaacatatttaatgttttagaaattaaaatgcatttaatacttttttttccctagtaagaagattaatagaaagattttgcaagagaatttagaatattcttttccattaatcatcatagattgggtgtatttagtcaataaaaattgataagaatgaatttataactcataaagacatagattcaattttttttgtccatgtaagaattttgttgataaataatatgtaagtatctctatcaacgttgactgaatcttgaggtttagtctgcttttgactttgatgaatttctgatattcaaattacaaaaatcaagtttaaattcaaatttataatcacatagccaattagatggtggtttccatgtttagtgagtgtcctaagagaaattgagaaattgcctcaaatattcatttaccaaaatcaataacattgtaggctcaatattctacaatgtaccttttcttttatactattgtggtatggtatcatggttgtaatttcttataaaaactctactcatatcttgagagtatttttaattgtcattcttcaatgaggatgtgtttacctgcttttcttactatattttttttttgttaaaaaaactatcaataattactatcacaatataaattattaatcataaatctaaaatatattttaaatgtttcaaaatatttatttattataaattttaattataatataaattatataattaaaagtatttatttattataaattttaattatatccaaaaagcatttattttttgtaatacacatgataaaatactagtgaggtgtaactttaaccgagagggtatttggtaaaggatatttttttatacccaaaatcataattcctaaaatcaagaatcctaagataataattcaattattttatatgatttaaattttttacccaatgtagatcaattgatgaggttgttaaatttaaaaagttttactctgatcttttttaatgtcttgcttagaccaaattgatccttgtgatagtttttggtactaatgatgttaaatttgattgatgtcatattttttatttttgtcatgtgtgataaactaacatatgaacctctattgtataatagagaaactttaaaggattaatgtgatttttttaaaacctgaagcaccgagattctatttaaaaaaagaaaaaaagaaaaacaaatgttgtcataaagttttcataatttttatttttatttcttatgtaaattttttgaattttagtattacttgttcagtctaaatcatttacatgtgtaaaaaaattatacagatactaacatttatttcctcatcaggaatagacacacgtgcttttttaaaaatataagtacaaaaaacattaaatttttatatggagtaaaatcaaattttgacctagggataaaaatatattttatctatttcaaaaatagtttttttacaactctattaaaatatttcttgaaatgttgcaacaataatattctgaaatgatttgttaattaatgtcctaactatttttaaataattaaaaaaataaaaaagttttttagaagtataatatttaatgtattaaaaaattaagacaatgtattaataaaaaaacattttaaaaattataatacgtatactaagtacatttattagtatttttattcttaaatttaattatttatcacataagaaaatattttaaaaaattatttattagattcctacataccttatgagaacaattttatgataaacatgaataaaaaaatattcctaagaaacaatgataaaaaaggatatgcgcttttttaagttgtctctcatcagatgacaaattattatatataataatttttttacttcgataataatcaccctaaaaatcacaccaaaatttatttttaattgattgatcatataaaatcttacactgaccgtgtatattcatcaaactcaaacgatatttcctgtaaatgttttttgtaatatatgtcaaacaatgagaaattaatatttctaacttcgtatgcctggacaacttgttgcacttcctaattccaactattttttcttctattactacactactcggaaaagatacacttgaatgaaatgctactagatttcggttgaaaagtcacagaattttattttttttatattgaaaattgcaaagtcatagtggtggtactataatattgcagtaccaaattgatccctgcaaattaaatatcggacaatacatatggctatatcaaattacaagggttctctcttgggggaactacatttactttcatcgaacataactatacacaagaactccaccgaacctttttttacgtacaaccacggaaccaacgacgtgacaagatttaacttggcgtgttaaaggcagatattatagtgccaagaaagagtcttcagcctcctaacggtgattaagtcagtgtggaatattagctgagggactgtctggtggccaaagcactgtacttaacaaaaataaataattacgtaaaggcataacatacatacaaacatggaagagaattaagtaatatcctttttaaccccaaaatgattgaaatgaagaatgattcctattcctattcctattccgtcctttaagtttcatccctggccatcctagattttccttttagatccactcattttagtatatctgattttttattattaaggaatttgcatctctgcattccacatctgaattcgtgattttccagtctgcatgccacattttaggactattctgtctgtcgtacatttgcttaacattcaatgtcaatgccatgaagcaaagttcagcaaatgcaatgaaatttacccttcaacctcccaagatattcaaaattcaaatcacaaattccaaatgcactcctaatcatcaaacctatgaggaaaattgatagaataggcctagagagtccaaaataggtgacttaaatattaaatgattcaaatattatctttttaatattattcagttttattttaaattctctaaaattagatgaggatacttgtgcggttgttattgacaaccattttaggttataaattttatccctcatttggctgagtatcaatgaagaaatatttgagtctttattttattagctctgtaactttctatagttttaatggtagattgataggagtagagtagtagctcttttgagcctataaaaaatctagttgaatcttcctgtcttgtggcaactgacatcttggtaagcatctaactattctacatattccactgacacttcatgtttaaacaaaaccctgatataaataacaaggtgtatatgtccatgcgtattagcatattatctttcctgtactgttttaattcaatcctttcaaaataagaaataaatatgaattaaaatacaaattgtatatttgaaaaaagatttgtgctcctggaagacaaaacaatttattaaaaagggatacaaataagtcattggaaaaaaaggaataaaacctgcatgttagactgatactctctgggtctataatgccaactggatatgttctttcatagatattcctcacaacaggaacatgattgaatctgcgctccttcataatcatttgagcataacgaagttccatatcaggtgtagctgtccatggcacgctgcatatttctccatttaaaaggcaaaattcagaaactaaaagctcctgtaagaagaagaaccaaataatcagatttgtgaagcaacaacaaagtagtttagttcagcagttgataccaaatatctacaaatgaaacacaattaatagaaaaggggggagggggggcttacaatatcttcaaccaattcatctacaaggcactttttaaactcggacttgtgcatcccaggttacattacaaatatagagaacctacatttgtgtaatgactgctggttttcaaacaatgattggttaaatgtgttgtatcaccgattatgtattatgataagtgtctgccaactccaattcatggtataaaattgcaagctcataattaagatacaatttcaatagcatacccatcacctattatcttaggatttatagattcacatccaattaatactaaacttggattcttgtaccttatgttttgtgcttcttgcttttgcaaatttaccatactcttgaatgtctctaagcgtcaaaaaaccgattaaagtatcatcggtatcaacaattacggcacaagattgtttctctgcaagcatgagatctattacttctataagtggtgtgcacattgaaaccgtcacatatcttgtcttcatggcttccgaaacaaatgttctccttacaaaatatgttgtttcaacattatcatcctctacacaaagtgaactttccacttgacacaaattactcaaatatgacacatcttcagcaaaggtattaccagcagatgactcaattgaactacgagaagatatttctgaaagtaaagcagaatttgagttttctaactccattttttttgcccctctgtcatctcctctttttgtctgtacagatgaaatccatgacgacaagcctacagctccaagaagtggtagaacaatccgatagtcctgtgtcaattcaaacagaagcaaaactgcagtaagtggtacttgacaaactcctgcaagagtcgctgccatcccaacctgcaaaaggaacttcaatatggtcatctatgcactaagcgtagttcacaaatttatgcattatcaacatgagacatttgtaggcagtgaataaattcttcagtatctgaaaggaatcccaagaaggctgctctggtctgttaaaggagagagagactcactatggagttatacactaatgcaaggtccattatagatagaaggtccacttcaagatattgtatgttcttgggtggaaacttggctacatggagaagcaagaagcaaagcgtaattgcaaggtcaagctcatttttgggctatagcagttctcatcccttcaattatccaaaagcatatcttcattgtctcataaaaggaatcattttcttacactatacagtgcttcagaatttcaaattgctagttattgctttcattttgttttagagtttgagcttaggacaataggacctaactaaacgccacaaaaccaacttgtaaggagaagactgcccaagacttataaggactacattgattatatctttagtcgatgtgggatctcatcacacctcgtcaagcctaggactagacatttggagcatagataatgcaggtggcccaataataccacctcctcatgcctaggaatagacatctagatcatacacagatacaagaagcccagtaacagatctaggatagactctgatattatcttaagaattttggctcaagacttctaatcaaccccacaaaaccagcttctacagggaggattgtccaaagcttttaaggaatatattgggcatatctctagtcaatgtgagatctcaacaacgttaataggtgacagttctgaaaccaacaaactgaaaacatatcattatataccatgactattgataattggaaatgcaatggataatgctatttgtaagcatgaattgaagcttatgtaaattcattccagctacttgaacacaaaataagttttatgatttcaccaaagagtaaatgctttgttcggaaatttagaggctgtatggtttgttttctattacaccatttcctcacaaaatcttgaaaataggaaaccaaatgaaaagaagctagcgtctttgaaattgttagtgaaaacatatcaagtgaaaataaaacagagcataaaccaaacacccttgaaatgtataaaaaaaaaaaaaaaaaaaaaaaaaagcaacgaaaattagcaaaagaaaaaaaaagattcaaaaattactttcctttcacttgattggatgtttacaaagtaacattattgaaacacaagcaatggacctatcctccactctcaaggaatcgaaaaattgttagaggtagactacttatcttttatttactgaaaaaactcccaagcaagagaaatacctttcatttctcttccttctttcattttactttcagcaaaaagtaatatgtattataataataaggtaagtacaagtggtactattatatttacactgttgccctactatgtgtagacctatggagccctaatacaagctgtattgcaagaattaggcatccatagatctggatttgtctagataccccttcacaaaagtaacctatagagcaatccccccctgaatacaaaacccgacccttatattcctagcccaagaatgaaaaggagccatatccagcaagaaaaaagggcatcatccatcagcttaatacattgataacctaaaatgccaacttatgcatttgacatttattgtacccatggcatccttcttttaatcagatatttaacaaaagaattttacttacagagaatagattacaggacagatgtccaagagattctcctaagataacatgcaagaactgaagagacaggactttaacatcaaactagttagcaaaccttatggtccctatctagaatcaaaattctgaaatattaaaaactcatattaggtacacacaggaaagagagttcctcttggaaatggctctttgtagacccatggtagtcatcttggaaagatataattgatcccccatgtcaaagagaagaaaaactgacgatgccaatcataaaatacgaaatggtaaaaaccatataatagccaaaatggaaagaatagtaccaggccataagcttgtggtgatgccacttccaacacagagaggttaatcgtgggattagactcagcaacagccaaactaattaattttccataagccatcccagttgcaccaccaataaagagagacggggcataataccctcccactaatccagaagccctgcacagagaagttgcaactatcttgacagctattagctgaagcaataggtcagtggaaaggcctttaacaaatggccgagattctaataaaatgtcaatattctcaaaaccccagtagaggatttcaggatatatcaatgctatcaacccaactgataagcctcccaatacagggaatgaagatcgtggaatgccagtggccttgtgcagattgtcaacaatagtcaacatatatgatgtacatctagatagggccaatgacaccagaccacataaaatacccagcaatagatacagcgggagctctgaaatcaagttgaatactctcactttaaaacttacccatcagattgagaatagcaaaatatgttcagaaagaattcagcttttgttttcttgaatttcaaaatcagcagttcaatacaatatattacccaccagtttctgtttcatagagactaaaaaacaatagagaatatacaatatcaaacctgaaattctgtaagcagtattttacaaatgaaatcatattaaactacaacagaagttttttttttttttcatttgaagtttaaaatcttgcaaaagtatgataatgccattaatttattgctctacttctgaagttctgatggtcaaaccaggagattcatgaggagtgatgctgtgcacctgtgactcttgtagatttagaagcagtcaaagattttgaatgccagcagtacagacaattcgcaaatcaattagaacaaaaacagcagcagttgccgcagcaatgttggtaataaaggaaagttttcagcagtcaaaaaggagtaattgtgaaaaagcattagtattggcttgcctagcagaagaattgtcaataatgatgaccatagtgacaagatgagcatagtcagagaccacgttgatgatgaaccgttatgtattgaagcagaaagatataagtaaaatggccatactatggaatttatgcccaagtagttcaatgatccaatatgacaccctaaaggtataatttacttgcatttggctgcttaaatcttcattgtaggagaaaagggactagcttactagaggcttccatgtattattatacttgactagatttaaccaagtttgtaaggaaatgtccaggtacagccattctgagttgtatttttgcaagataggcacagtcagttagtcaagtgcgttgttaaaccaattcagtacacatattaacacatacataaatggaaacacttcatgtattgatatactttgctgaaatttgacagggaagaaaggaacaaagcaatgaacaagagcaagagaatgaagcggtcaagtcataaataatctcaaagaaaaatgtgttgatgacttaccaccaggggaccggaagtcatactcgggaactttaaaggcaggttgagagccaaggccaatctcagaaactacagaagctatgacagcactaagtatcaccatggaagtattatttgtaagtggtaaagatgcatctgcagatgatggccacaagacagactcgacagcgaaaaaacaaccagcgaccgcagcattgaaacctgataagaaatataaattagagaagaaaataatcggatcccaggaaagtgataaaagtaacgtgtaagtgtagataccggcagagaggccagcagcagatccagcagcgagaagggagagcattctgccggaactatttccattgtcaaagaaaggacggaggcctttggcgatggaagtaccaatatcgacactgggaccctctggacccaaggaattgccggtgcctagagtaacagaagctgccatggcctttaagaaagggcgggaagcagacttgaggttggcagatggagtttggaggaaaggatcttcttggacagcggaatcaaaacgttgacgaaggaggtttagcagagacacaataacgcctccaaaagtcggaactagtactacacgtgcccatgttgtctgaataggcgcttctctcagccatgaggcgcctcgattgggaatcccatcccagaacaaatcacgaatttcatgaaccttattacatgtcatgaagttacatataagtatattatgataatagagagtatttatctatctatgtatagcataataataacaacttacagcataattgaagagcacgacagcgacgccggtgaggagaccgaccaagcatgaagatattattccggaatcgccaatccttctggtgaggagcttccattctaactctagtagttgtacttcttcctcttcctcttcctcttcctttccagccccagcttctttattatcaggcacacaacacggacgcctcgccctaattcgacacagatgagtctcgtgtgcagaagcagaaggaaacaacgaccacgaccacgaccaccaccttgttagtgttagttcttcagatttagaagcaaggattcgaactcgatcatggtgccagctggggtgaactcctactcctgctatgcatcctaagccaaccatttctcacgatattccaacttcttcccacgccacactaactcatttttccccctctaattgaaaataacttttaaaagctggaacggataaacaatagatgaattttttttgaagaatgcttacttattaaataataataatttcttaattttttcaaaatccaaattttacacttaactttttttttatcatattattcattatatctattacttgttttttctctattacttctctcttttttcacaaacaaacaaaaaattattcgatctaaccaaattaaaattgaacttatgcatatataaataattgttttttatatttataatatcactcatttacatattttttccttctatatttataatattatcacataacttgtttatgagatatatatttaattaaagataatttttgtaactaattaagtaaatttattgataagttatctagttgtgtaaatttatttttgtacatatttaaagagttatactactattaattatatattgacttataaacaagatattataatttttaatgttttttatgtttaatatgtattttattatttatttaaggcttaattaccaatttgttcactaagttatttaaatgattaagtttggtttttaaacttgcaactgctctaatcagattctctaatttttaaaaatacttagaatcgagtcatttccatcaaattaaaactaataccattaagatgagatttctagaggtttgatttaccaataaaagacgtcactatctttaattttattttaaaaataaaatatttttcccttttctgaaatcaaatctgaaacctacaaatttggaattgaatttgaaactcacaatacacaagcacaatcacaattattgtattcggaggttagagaattcgttggcggtggcatgacgagggagtctatgatggtgagatgtgtcatcgatggaattgatgcggagggaacaaccaaaggaggtggtgttgcacaatccgtcctgcacaacatacatgtgtgcgtagtttccaacgaacaacattgatgtacgcagaaagaataagcgagacagacgtgacgatagagaatgtggcgagggcattgaaggaccaccgcaccatcctcccttcagatttgaacaaaaacgcgacacttttccttcagatctgtacaaaacctcaacagtcccttcagatctaaacaaaaaccgcaccaccctccctttacatctgaacaaaaaacacatcacactctcttcgtatctgaacaaaaaatgtgcaaccttcccttggccactgtataactacaacaacccatgttgttaccatggatgaggactacgtgaacgacaatggtgttgaacgtctaacaacattagtttaattggccagaaagaatctaattgatgcatttttaaaataattttgaaattaaattaataattatttaatatgttatttaatacaatctcatccacaaatactcctaagtataacattaagagtattaacaacacattctttctaactttctaagataaataattattaattaatttttattaaaattataaaatcataaaaaatgctcattaaataacaaatgactcttaaaaaaaattatttccaaaaatttagtaaataattgagcgtgtattcaaaagaatatatcaaaaaggatattactaacatttctggtatcttaaaaaaaaaaacacttctcgtataatatttctgacgcggcaaagtactcacttcataaaaagcattgtcctcggccatcactttgaaatcagttcacatgcacaagaacctcccaaatttgctaaggttcgatcaacaaagtcacatcgctcaaactataggttttccccacttttttagaactcacaaaatttaggatggggcgagggaaggctattgaattgctaggtcagggcaacgtccttaactccaacaagagcttctagtggaatttacatctcacgcatcaagaagaataatgtagacaatcgaacgtaagcctggttctatccatgttgaatgttgagatacacacactattacagtgaactaatatgtattcgtttgctcaaggctaaacaacaatgaataaaaaaaatccagtataggaaaaacagaagacagaagtgatagttatctttgtatcttcccagcagagtgcagataaattgcaacagagacaacactgtaaacataatttaacaaacttttattcaagagaaaataaaatgggtataaagcaatttacgtgagactacaaaatgaagcattaaaagctattgccccgaggcatgcacatcaaaatgaagcatttcaaaatttaacacaagttatcattaagagccaaagccataaaagtactaaaaaaatcaacattttaatttcagttgctggtatagtatgatgtattcatgtatgtgcaatacttgggtcatggaaaagaaaaacacaacataggacacggcaagcacaatcatgatataataagcagcaacttacactgtgcccaggaagaaggcgagggagagatggaagccaaaaaggaacacagaaacaactgctgtaagaagcatcgcaactgaagtagaatacacctgtgtcaattggaaagttaatcataaatttgaattccacttcaaaggttttttgcttgagctagtaaggctgtaagggtgccataacgtttgaataaaccaagaaaaacagaagcacacatatagatcacatttgatgaaagcattcatcaatcatcataatgcagctctacttctaaatactaggcacagaataaaacttgtgtgcagttcattaagcgagctcagattctacaatcaatatatgataatgtgttcagagattgtaaatcacattctatatactcaaacacaggatttcctcatgcaattcagaaatcgtttctcccttttcaagtatgatgataagaaaagaaataaaataatatcggacagagtaaagtgatgatagaaattttaatatatttttcatttaactgtagaacctgagagcaaacatctaatgagcatcacttaagttttgtccgtaaagaatagtgggggtctacagcaaagtaacaatatcacacactctagccaacaagagatacccgcaagggcacataactctaaccccacaattttttgcataatttcatatttatattcagtatgtgtgaccatgagacatacaacaaaaagtgtatcatatgaacaaaccaataataaaaagttattgtagatgtagcatgtttaatcatatgaataattccaattataaaaaaaaaaacccataatcttaatttaaactcatgaaagtttcaaattctattaatacaactaaatggtagaaatatcataacacagtcataaacccaagtcttactttcacaatgttgtcagcatatttcattaccattgatacagcaattccactgcaaaaagaaacaaccacgtaaacacattacatcaacaagaaagtcaaaactgtaaaacaataaaataatgaaaacttctactagtatttgcttgaaaagagatattcacattttttgtgtagtgaaagagatagaaacagacacatagaaagagagaggacttgatgagttaaaggaaaatagcttaaaaatgacaacagttgaatatggaaatcaccaaagataaagttgaaataaagcctgtttcatgcaattggcacatgaaccttcccgagatttgcttattcacagtttcatcaaccatcaaaagttgtttcatctttttgtcgctcatactccacagtccacatctcaagtaacctttcatttcaggaagaaacagaagaagcatccaaacaaaggaggggaaatggttgattaatagaacaccaaaaacagaagccagtgcacgactcttatccatttcaaaagaactgagcctaagctcatacaaggatgcaaccagagaatggactgctgggagaaagctattttctgtcaacaaaaaaaaaaaaaaaaaaaatttacgccagcatgccttgcagccactccttgtattcccactctactcccaactgatatgtcaaatcagcataacaaattcccctccctgtcttgaatttggactaaagcctaagaattgtccaagcctgtataagctctacttttgccatatctatagtcgatgtgggatctcaatagactggatcccaacaactagtggtggagggagggggtgacccacaagggccatggtcacccccaagcttttaaagtgtatttatattgttaaacaaaaatctttgtccctcctagctatctaccataaaaggaaaaaaaattatctatcctgttagttgttctatttcttctcagacacgctaccctactctacctccacttggttttcttctttgagaatttggattttcctcagttcctcccgttcttcttcactcttgatcaaatcttgattcctctttatttcccataatttaatcatttgttagaatcatattgagtttcttttcattgaagtgaataacatccaaaatgaacaccatacttctatccttttaagttttaaggaaagattacaagaagacaagtaaaacccaaaatgaataaaatcaagaaacatattgtgaacccacatacaaattgtatcagttggtttaaaaactttaacaaagtagagaaagagggaaacaacggtaaatttaaatggtcgcgtatacctcttgtactcaacccaattatgtatttcttttactctaaaaagtattagttatacatataaatttcctgcatatgttatgtatgtggaatttatttatttagtttttactaagttatgttttgggtcttggccccccttaaattaaatttttggctattcccctgccaacaactagatacacaagaatagtaattagggaaaaacttccatccctcaataaattttataaagctcgtcatttacctgagtgcatggttgaaaatcatgagaactgtaatgaatgaatatccatggaagaatcccctgaataaagacataaggcatatattactgacgtgacaatttaggctttataactacaatggaaatatgattgtttataatacttggtactgacttatatgatcaaacaacatatattatgtgttattgttatgaaccttatcgtaggatcaagtcacaagcctagacatagaagacttctgtcgacctatagtgaaagaaagaagcagactcgtccttgactgagcccctcctaaactaacacaagtttttctgaatatttctccttgattaaatttcaatcaagtttgccatttaaataggctacaaaaatatccctaacaattatcctaattgatcataaatgataaaataaaaataaagagaatcctaactaataattatcccaaagaatataataaagatctgatctgaaatcaagattctgatatcaaacttattaagatgggaaaagataaaataaataattcaagatttacatacaataatcctaatttgaggccttatcagttatcccatttgatgaaaagatttacttcatatatgaacacaagaaaatagcgagcaaagatcaaaacaaactgcaaagtcaaaatctgaaagaagagatcgaattacttgttcatcaccgcatcaaaatcttgaaccaacattgcaacagcattgaaacacatgccaaagacatataaccagaagttctgaacatttatgttccgtgaaggacgcttttttataatagcctgccaaaaattatgtaagaaatctactaagccacaattgatagctaacacatcttactcgatgctatagtaatagagctcataaaccttattttaagcagactggcacatctccaatgattaatcaaatttagctcaagcattaataaattcagatagactggataaataatttcaacttaatacaaaaagcgtttgaatctaaaacaatttttaagcagaatattccatcagtcaatagtagtcaacagaacagagaataattttggctgtagattggagtggagtgccatttcatgaaacctcaagggaattaatgaaactaaaattacctcagtatatactcctgcaaaaccactcaagagagccatgacctaaaaacaaaaagttcatcatgatcagtttcaagccaaaaattcagcttatattactttatactcctaatgtgaaagcaccacaaacgttaacaactcacaattgccatcacccaaccttgaaagggagtttgaagaacatgatcagaactgaaaacacaatacaaatttttccagataaatattaaaaaaaaaaaaaaaaaaattatcaataaaatgtaaaacttctgcaataccttttgtgtgtagatcgcaggtatattcctactatttatgtatgatacaagcaaggagaagttactgtaatacacacatttttcagcagtcacacttgctaaattactaacctatcatttatggttcatttgtttgttacatctatacataaaaatttcattaacatgtttattactagagaaaatctatacaacagtcatgggaacatacaaatacacaagtgatggccacatgtcagccttaaattattcttacttcgaattcaactgggctgtagtgcacccagcagcgagtagaacaaaagcagcccactgaatctcacttaacctgaaatgtaacaagaacacaatgccaaacagcgaacaatgaattttggttatgtaatgagtccaactaaataacatttctcagtcattaagcttaaaatgattaaatatccaaaataaagaataataacaattaattatgttcatagaacatttcataacacaatgagttataaaacaagtgaaagtacgatggaaggagcttttccttctcgtttttgtccacataaaagtttggcatacagaggacccgacttgcattgatcctccactacagttctcatggcgaaaggagaattgataattttttttttttttttgcatttgaagaagagagaacaaaagacttaccttttcttaagtataattctgtataggacacccgtactgataatattaaagttctttaatatttgatagcctggagcatctacatatgcaaagatgtaatactgccgtaaattgaaaagtaaatacaatcagattcagaaagcattaacatatctgttgcaataacaaagttgtagaacaatcccattgccaccataacaaacaaccatccatcaccaacctgaagcaaatttttgacaaggtaaagtgctgctggaataggatacactataacttcatccaaggttgtagtcaacctatgtccaaggaacaatacacatcaagttatcaagttatttaaactcattctatatataacaccaacaaggggttctagctcaattggttaagcaatgtgcgtgaattgttgcgaacccagattaaaagaaaaacaccaacaagggggaaaaaataaagcttcaataaaaaagatgaagttgcaaatacataaacaccaccgggaaaattaagtgaacccattggcctactcaacactattaacaatataggttctagccttatgaactcctctccacctaaagaacactgttcagacactccccccaacacacataaaataaacaccatataaaggaatgtttgtctgtttttcaaaattaaaatatcaaaaaatagtggttttgtagtcatggggaatacagttcaaaatcacattaagacagtttttggttttaagagttaccttgtaagaccatataaccaaatgttttgattaccaagtgcaactgtgattacttgtatatgatgaagtattaaattttcaatcagattcacaaagtaaacaactaatttcttcctatgaattagccatatacaggttatttcttcagggaataaggaagcccaagagtttacaaatgcaattaacagtcaaattagtccagttctaaaaatgtcaaaaagatcggattaaaaatgttcacaaccataaataaagataaaatgcactgttaaaatgttaatatattccctgacttgcagctcttcattattgcggacatagtagtatttaagaaatctaaacaaaacaaaaaatggcatcacctgttgtcctcattgacaccgtcttttttccatattcttcccaaggccaccagggatatagcacattttaaagtctccacctataacaaaaagagtaataaagcaggtttaggtttgaagttatgaaagataataaaagtagaaataacagaatgagcgtataggatatgacgatgtgatataacctcaccataaagttagcagtagtgacactatactcatacttgccagctctcttggaccaaacgattagaatggcttgcgaactagtaagaacagtcaatgcaagtgtaacaactgacctataccaacaggcaacagggataataattaagaaatcaacaagtaagtatttcacttattatatgtgaattgttgtcatacttgcgcttccactttactttctccctgtggctgtcaattttggtttctccctcggaagtcaaatcgttatctgggactggaagagacacgaaacggatgttacattaaaacaacacaactatccattattcagcctggaggagcgatagcgataccactacctgacagcaaaaatgattttccaacgtcctcaacgtccgcatccctaacttcatcctacaacaacaatgcatcaaaatcgtactattaattgaagaaatatgcgaaaaaacactcacctcgtctttgattttcctgtattccattatatcacagagatctacgctttgtgcattggataaacagagttcaaactctaaactcttactttccttgatgcaccggcaacagatctcggcgctcaccaattatgatattataaggccacgctctctttctgatctctctttgctatgcataaacaaaagtttactatcacattaaattagacttaattatatttttttataaaaaaattatctttaataaattaatttgacgtattttattaaattttttattataaattttatttttaattttttatatttttattaattttatccttaacttttaagcttaataatggaaaaatggtcgggataatatatacaatatattataaaaaaattagaggtaaaaataacaattaagtctttaaattatttgtgtaattagatgagttttgaaaaaattgattttaaatggaagtgattttgtaaaattaattttaaaattatgtttatggttgtatattattattataaaattaagtgaggagtaaaatttagtataaatctttttatccaatacaaaagttatttaaaattgttttaattcataattaattttgaacttttttcaatgaaatcaaatatgtcaaaatttatccaaaattaaatctactcaatcaattatacaaaataaaaccaaacatacactaatgactttggtatcataaaattacacaatttttacctttttttttctttaaacatttacaataactctcttacaacacataatgatgtaatgtataaaggaatatcaatgtatattttttaaacaattaaaagatcactgcaagggtaaaaaaaagtaaggaaaatttatgtaattttataaaagtataaaaatatttgtataatttactcttattttagtaattgttgatcattttagttttccatgtttttataccactattcatctattttattttataacacttcactttattcatttaataattcattgtctaatttatttaatgtttacaaactaactttttttatcacaactagagttatgttgtttgaccacgttaaaaaatacttcataatagcattttttttaatccattaaaaaatcacattaatctatcttgttaaccattaacgtgtaaaaatggtcccgtttcatttctttcttcctagttcctactatgagctatttgtgcctttgaaaaattcattttccttcacatttcttctcaatctggtgattatcattcaaatacttttttaaatagacaacaattaactcctcttattattattatttttttgcaaatttcttcttctatttatattattgtgtgtatatatgctttggcttcatttttgtagattctatttgtgccttaggcttcatttcttcttctatttatgcttttgcaaattttctcttatttttttttatattgttgtgtgtatatatgttttggcttcatttgctttttatattgttgtatgtatatatgttttgacttcattcgcatgtatatactccatttatccttattcttatatgcagatcgaagtcgttcacttctctgtcgaaagagcgtattcttttattatagctaattacaaatctcaattagtcttgtttgtacaccaatcccaatgactaattcgactcttaagcctggaacacaatcaaaaagaaattctcttttgtctctccctcgaccaatttttacattagtgggcggacaccgccccaatcctaaaacaggaacgaatctttcaattgcagttgaccacaagataaagaaagcgattgaagcaagcattagtagtatcccccttccttcgttgtaggtccccctcccttaattatttatttagaatatccctttggctatcaactcaaagagtaaagcggtggtaagatatggatttttttgtgctaatcatattttttcttaatatatagattatttatccatgtttctcgcatgtattttttccctctaaaatcttcaaccatatttgatatttagttaggacatttcttttagtacacatgcctccttgcgtttttgtggtaaaattgttaaaagcttgctaatggcttatttttctttcttggagacatttactgattaattagtcttttctttttttgttcttttatcttttataaaaaaaaataacaagggtaaaatggaaaaatataatctttatacatagcaaaaaacacttaatattgtttgtgccataatagattatatacatcatacacttcaacacatatttcatgcatctatcttaattttgcacgtactagatttttctaacttttgcttgttttccacaatatttgtactatcatttaaaatcacaaacattcaatattacataaaagggttttaatatcggttatagaggaatttcaatatcaattttagaaccaatatttaaactgtcattgaaagtagacatttttaatgtcaaatttaaaatcgacgttgaaaatcattatctacatcggttagctgaaatcaatgtaaaaatgttgccaaaattatgtattttgaagtgttttctacatcgattctgaaaaaatcaatgttgaaaatcgtatacaacatcaattttttgcaaaatcgatgttgaatgtgttaaaccacatcgattttggccaaaatcgatgttgaatgtgcctttataacatcggttttcgatcaaaaccaatgtggtatagcacattcaacattggttttagaccaaccaatgtgatatacttaaatggttagcattgtgcacaataggagtgcccttgcactccttgcacttacatttttgttctcctaacaacagagttttacattgattgaaaaatatatgataaaaataaataacataataaaaaagtatcttaaaagaaaaaagtaaaaaaaaaaaaaataagtaaaataacgttgcacaagagataataaagcattaaagttgttatagaaagctaagtaaatataaattacaacacaaatctattgaattagtattgtcattgcttccatatgttaataacaataaacatcaagtttgtagaacctcaatatagaaaaattgttctcaatttagagacaagacaacaacttccaaaaaccacttaatgagggaaaggaagatgaagaaagagcaaatataagacgaatagcctacaaaaaaaagtgaatgctgatgaacaatgttaagcctaaaataacgttgattcagtggcaatgtcgtgtttggttagagtaggttgcactacatatgaacaggatgtacaacaagtaaattgtcaatgacatacacaggcaaaacatctgataatcctccattactaaactagagattcacaacttgtgtaacaggaaaattacaaggcaataatcagagacttcttccttgatagattatgtcaatgggaataacctaaaaataaataccaaaatttgagccactagtgtcactgagagaaagctaaacctttacgttttcacattgaataacctgagaataaataccaaattttgaattagaaataatttttttttatcaagaacaaagatgtgattaataaggcaatggtataaggatgatagagttactaatatatctgagctttacatattaacattcatagttttaggtaatattactaaaatataaggcaagtgcatatttttatccaacttctttcacaaatatttgcagcatgctagaaaataaaagaaaaatactatatagcaattagcaaagagaaaatttggatgaccttttcacaccttaaataaaacattgaccttgttaaaacaataaacgcgtgattcatcaacatttaaagagttataataaatgctttaatgaaaattgtgtggaaattaagaaacaactattttgcttttgatacgtacctacatggatttaattgtaggcatccatttgccatggcaatttaacgagctttgaattaatccattagtggtcctcaaaccttgtattagaaactggtaacttttactgatccactatcaagttgatactactaccttggaaaatacagaaacgcatctatcagcaactaggcatagtagccctttggttttagatgagacttgcacatgcatattatattacaaatgcatgacttaactcaatagcaaattgtttcaaggaacaacttcctaatctttacacaccatggtaaattgtagttgacttggtaaaattcaacttcagtgtaactctaatttttgttatcttacacattcagggacgaaaatggttatttatccataaatttatttataattatactatcacattttttttatcttatattgcttaagttcaccatcatattgtaatgtctaagttggtttcttatatgctttgacaaattataatgatttttttttcctgcatataaattttgtttatccatttctttttcctcgctaatcatggttttttgtacatatttatgcataatattataatctttcatgagttaagtcatgaacaaatcattgttatattaattttatagtacatagcatgatttgatgccatattttgccagttaagttttcaactatatagtttttacttatttttaaaaaaaaatatttatgaatggcgtccaacaaacttgttatttagaaaatatacttaatctcgttcaaatggtgtataaagtcaacttcattggagagattaatggcacgagagacttggaagttggcaataagaataaatagtatttggcatgtgcagaaatctcataaatcagcaatgatgaaaatgaatatcatggatgtgaagatggatatgaatatcatggatgtgaaggtagtcttatattgcttaagttcaaaatcaaatggaagataattgtttattgaatttaatttgttcatgacgtaggaagataaaatacaagttgcggtgaaaaaatatgatgttgaaaagtggtagtcaatactcaaggagggtaatacctatattttcttgaattttgaattcattgtaacaacaaacaatataggatttctagggatccattaaagttggtgttcacgaggagattaggggaacaatcttaaaagaaatataatcttagaatcttagaaaacaacaaattattttcaacgttttctgtacaaacctttgaaaacaaattaaaaccaaattaacagttttataaataaagggtgaaaataaaaaataaaaacagaaaacaaagctgcaagtaagcgccccctaaaattcagagattcaaagaatatattttataaatagttggtgaataaaaagacaaatgtgaatatcatgataggaatattaggatgaattttgtttttattaggtccaaatgttttttttttttttatgtttaagaccttagcatttagaagcaacattattagaccttgattaatttaacttttttcttggtacacaaaattaaagtagaatacttataaacatatatttattttctctttattttatttcaaattatttttaaattttattttcttattatatcactcatcacatctatcattttttatctctattttttcttttatactctaatccactaaaaaatgagataaacttttatatttttttactttgaatcaagtcaaataaactcacttaattaaggaggtaaaattctctgagagttcatattcttaatgaagaatatatgacttaaaaaatttagaaaatgtttttgcaatatataaaagcaaaaagtagaaagtatttgaatggagcattattacaacaaaaaacacgtgagagaagagccgacaattacattggcaaccaatgaagcatttggatctactattgaatttggcacaaaaacacctcaccaaagcgtcttggattcaatgagagagcagacaagtccagtttaaatagcaacacatcaccgaaccgaaggcaatgggtggagagagagaaatggcgaatggtgactgacccagcagaaggaataaaacaggctgtggtagagctgtaaacgttccatttcaccactcttatgatatgatatattttctccgaaaacatagctttgagcaaacagcagagcataatgtttgggtgtacaaaggcatcatcgctgccagtgtcgtcgcgttcagaggaaggaggccttcgaagacgtctttcttcgctgtctctgaagatccaagacagcccaacatggtcatttcccagatccaagtccctctcatccatgggtgactatgcaaggacatggtgggactggagctgggcctggatcctctccaggaagctcatctttgccacagatctcgaaattaacgaccaggaaacaaagctccttggctcccacaacaggggcacttggaggcatgttttctataagcttcgctctgagatcagaaggttcatctctacttctgatcacgccactcttcccaaaacctaccacagttccacccctcaactcttctcataattccctccacatttctcaatgcttccttcaaataatttactctttatttcagatccaccgtggaaagcattacgtaagccaattttatgtacaattcattcttcatgttaatttgtttcctgtactcagttaattacgtgcatattctattaattgtggattgttataattaaatttgttgcctaatggaaacaattgaacatcttatttatagggtgattgttgcatactgtattatcttatagttgtattctatggtgaatgtagaacctgccatttttctgtttcagaatcccctgccctgcccaagtaattcataaataatgattgctgaattctgaacttgttgccgtgagattgaagtttcctctcccacgtcctcctattttctcctttttcattacacatcgtctgatgccgttttacgtcgcggttataatataattaagctaacttccttccacggttccaccaccatgttaccgaacaccattattattgctttgtgtcggtgcacaatttcttcttttattttctgttttttctttctaaataacaaatatagctaaatcctacatgcaatgcttcgtttgacagttggcggtaaggaagaaaatcatgtagagaagataaatcggtgagaaacaagtaacgtaaaaacaaatatgtaagaaaatgagtgcatttttatattgtttttgtaggtatggtaaaaaaaatagaaagaaatgcttaatttttttttatatatatttgattagaaagtgtaaagaaagaaaataacgtttttgtttaacacattatttaaaaaaacataagattaaatgacaaaagtatcaaatttagtaaaaatgtacacaataatttttttatcgagaataatttttatcaatttatatgttgaatttaaagttttcataaagtataaataaatcgatactattattagattaaatatcaacaaatattcactttaatttttcttttatattatgagcttatacaaaattatcattaatataattatttaaaataattattataaaaatcaataaaatttatcatattcattttttactttggacctcaatgtccccacacatgattgttcatgatcttcttaaatagtcaccgacatggatctctccagttagaaaaaactggaaagtgccgaatttacaaatctcatcaccatttatacatattttttttaatattttatattttaaaattttcaaatattaaaataagctaatggttaagatttcatgtagttacaacaatttagttcatggatcatgaatggtcccaataaataatttttatttaataataaaagtatgagtaaatagtatataaaattagaatataaaaagtttcactttatcatctaatcatataataatatattaaatttattaattttgatgataattattttaaaaattatatcaataataatttaaaattgattgaaaatgtaagtttaggtgaatgggacatagatattaaactaaaaagtattgtgtgacctaaattaatgatggcaacccgtggaacatttgaaccagctgtcgtgtttctcaattctgtgaaaattgcaggttggtcctttgtaaaatatagggtggggaagaaattttgtgatttgggggttttgttgcttcatttgcaaaagcaacatgatatgatgtgagcatgcatatcaaagctacaaatccttatagaaggacaacttgtggagctcaactgcatcgaatagtggcagctgatgggtcgtggtagtccatgtgtgacaacccactttgtggcttgtgctacaattttaatgtctttttttttttttttttatcatggaggtgagaaagagaagggtaggaacagggcgacacaatcagcaccggcggatctacgtaattgagagtgggcagatgcatcccctcatttcaataaattactagtatttgtcttaaaatattatattttacatcccataattttatattttgcactctctaattttatgtatttgaatctccttacaagtttacatgtaagagtaagtaaatatatcatcttattttaataaaatgaaaaaaatatcatattttgcaccccataattttatattttgaaccccttaattttatgtatttgaacctccttaccagttcacatgtaaaattaagtaaatgcatcctcttattttaataaaatacaaatatttatcttaaaactttatattttgttcctcttatcttcgtgtttgaatttaactatcccatataataatgataattatcaatttttattttttaaataaattgtccccactaatcagggtcctagatccgccactaacaaccgggaaggagaattcttattgggacgatttgttattggcttactgccacgatgagagaccattattttggtccacttccctgtggatcaatttgttgcaaattcgggttcacatcgaagattgtggtacattaggatgcatgcaggattagaaggtgatagagatcgagggatagtttgttgaaataggtgagtaatagtttgttgaaatagctgtgttagtaatattgtcgaattcaccattctacttaaatttgggaggtttcataaactgactaataaaatcgattcgtaaactcataatagtttactcaatataaaaatatatattaatattcttatatataaaatcataattaaatattttaattctaaaataaatcaaaataacaaattttaacaataattcaataaactaatataattcacacccaatcaaacataaattcatatcatacaaaacataaaacataagttcttcaaataaaagcatttaaaaaacataagtaattcaaatgttcatcaatcttctaattaagtcattttcaatatcaccatcaccatcatcatcttcatctccatcatctttaagttcttcctcgattgagaagtaatcttcaacattgtcattcaaaatcaaattgtcaatatcaaatgcatctaaagttgaatcacttaaacttcttcctccaaccacatcaatattacttccactacgactttcacctagaggttgctcaacttgaacattgtcttcatcaaaaatatatatccctcttatgttatccactcatcatcacattccatatcttcaaatggaagaacaacatttttttcttatttgtctacttttcagattcaagttatacatcacataaactaagtcattcatattcttttaatgcaagcggtttctcctctttgtatgaacctataaataatataaaaaattgaagttcataacttaattaaagtataaagtctaaactaaacaaaaacaaatattaaaaaacacaaaattgtaaaatcgtacgattctaccgagtttggtctaattctaccaagtctggtccgattctagcgagtttactccgagtctaccagaaaacgattctatgtgcgattcaactcgttaggagtgtgtagactcacaaaatgtatgattttaccatttaaaactagagtttgataaccaagttttagtattggtagtcaatagaaacaaataatgataattgttcatttcaatattgatctagttttatttaattaattaatttattgatattaagaaaaataattaatttaattgataataataaatatttttttattttttttcaattctatcattatcattaatattttttttctctatttaaaattgtgccttaaaaacaagctatttttaaataaaaataattaatataataaacattataaattaaatcttaaaataaaaagaatataatatcacttataatttgaaccttataaatagaactaaacgaaacatggcctcttctaatcctagacataaacaacatataaccaaatcatcaaaataaaataaaataaaaaagtgattatattagttatctttaattaatactaacatacattcaaattgtattccaaaaatatccgtaaatgatgattagatatatttacactactcataatccaacatatttttttcaaccagtaagaataagttatattattaatatctcattaaatacatccatttcattgaaaatgagtgatatcttactaatagacctcatttattaaggatgtaaaagaaaattagccactaataatttaaaattgattatatatttcttataattaataaaaaaaaataaccatttgtttctttagccgaaggtaatatttgatcaatagttcaaacagttaacatcaaattaaattaaataactgctatttttttatttattgaagaatgtttggaccaactttttctaacacattgtttgatactaaattcatttctttttccacattaattagttcatgagaaagcgaaagagactaaaaataagtagttcatgagaaaaataagcagtacaacttattttaaaaaaactaattcacttgacattttttaaaagctaattcccccctttttcttttataaaaaaaaaaaactgcttaattttttaaagaattttactctattttaaaagcttttattttgaactttctttaaagtaagctttagctataaaaaaagctagaataatacgtatttgtttagggaaagaaaagccagctgggaaataatatgcttcagcaatgtcactttaacacaatgcatcatactccacaaaggcttcttagtacgcccaatacatcatatcatgcgtgtgaaactttacatccgtgaaatcaagtacttgaaagatcaaaatccttctactaaactatagacagaatgcccctacatgaaagcacagaaaaatagaagaccaactcgaagtagctgtaacacccaacactaaggtttacaaagcgagaaacaatttttccactcatacagcacataaatgtaacatttgatgaatcctcatgcgtgagcacccacaatcctgattgttcttccgagataggaccggtcagcaagtatgaacaattttttgtaaagatttttactttatttttctctttttggctttgctgcatacaacctgccaaaattgcattccagaatacaggaagagtgacgttaacaatgagagtaataaaaagtcaacagatattcagctaatactcgttttggcaaactgcaggatataaactatcatgcaagacacaccttgttggaattactgcttaaatctagattcaactctaaatgcattattcaagatgcagaaccaagatctatgattggaacgatatatatttacaaagatgtgcttaacgggagtcccacccccaccctaagtttggtctcggggttacatctttttatataactactactactactactactgtatataaaattgcaaaaggttcatcagccagttggctcacgcacacctccaaatgtatgcagatatgctgccttcttcagtttatacttccataactcaagctaacctaaaacctcaaaatgatttttttttcatcaggaaatcatacaccaacatattacaaagaatatgctatagacaaggcagctccatagaggaccaccaatatcctgtgggttgatagtacgactctaacatgtattccaaactgtcattaccctcttctggggagcaagaatccaatgaataactcaacttattcagtagatttgatgggccatcattagaagaataaaatcaagtctagaagtatctgctaaagaacaagcagacacaacaaaatctgggacacttcaacttcaattcaacagccatctgcacaggatgctttacaataactgatgctaaaatgtgagcagatcccaataaaatattgggtacatacgcaaatgggacctatataaattgggaaataaggcttgaaatgtcatgaagtgataactgaacttcaatcaaatcatttcgggttcttaggttcatgatgacttcttgtgtacaattatttggaactttaacttccaagagtgagaaactaacatctattgcctatatgtctattccaaccactagagatggcctaccacataatattagaagtatgttggtgattacaagacataccatttgtgatgccttttgacctctacatcttaaaaattcataagaatataaattataaagtgggcaaatagtatttcttacaggggataaaagttctattttacccaaagccaaaagtacctgtacataatgagcacaatcgtaagctattgagcacttggtgcatctctcatgcttaaattcagactgttgcgcatagtcctcctaccaattccagcgttgcctttttgcatcatggcagcaaattcaccataatcaatccttccatcctaaaacaaaagatataaacataatcatgaagcataactgcacaagaagatggtccaggaactaaattcaattcattattgataggcgacaaagaatcatgcttgacaaattattagaattcaggcatttgatatttaaagtgtatttaaggcatgatatagttttgattaattaattgtttttcacaatctgtgatcagaaaacgtttaatggatagatcaaacataggtcctaacttcctaatgcataattcttgtagctttgaaacgaaactccagttaatgcaggataaatgcaaattaatatagcttaaaacatgtaagcattctttaaccaaagaacattctatatttcaagctaaaaaccatttaagttattgaagtacatattacagaaaaattgaagactaaaagagcagtcttttaatgaggatatatattactatactgtaagatcttctaacagcctacaaggatttcctatgtgaatgtttagcacaggttaaacaacttacattatcttgatcaacttctctaataatatcttcaagaaaagcatcagtcatgttatgttctgcacaagcttgttgaagttcatcaactgtaatgtagccactaccatccttgtcaaaatattggaatgctgcaataagatgttcttcacgctctagtttgttgagatgaacagttgcagcaataaactccccataatctatggttccacttttgtccacatcagcctgaaacaactcaaaacattttagctgtgaatgaaacatgttcaaagattatttaacacgaatacaggatgtggctcaaaagaaaaatggagtaatgcctgtaaaagatgactgaatagtccctggttttcactaatgtgatgcctaatgtcaacccccggctttcgcatataaggaaatttaaaatattatatttaaaaataataactaaataaaataggaagtataaacacgaaatacaaaaaagaaacttttcgcagaaccaacaacctaccgcttccataagatcacgtatttctatatccttaagggtagacccatatcttcttagaccagctttgagttcatcgaaagtgattgcaccactgttatcagtatccatagcctgaaacatttctctcaaaccagcaatctcctcttcggatagactttcagcaatcacctaaaaaattagtataataagcaattataactacggttacatagtttcagacaagcaaaaggataatagatgaaggagaagtgaaaacaaagggcaagtgtggaagcccaataaagtgaggttcatttggcatccaagaagtgcttgactccacaaagacaacaatagcactttacatatcatgtatggaatccattatctttttcataacaacgtatgagctacattcatacatactatatttattcatcaattagcttcacttagagaacgagccctgacataacggtaaagttagatcttgatgatttgttggtcatgagttcgaattcagaaacaagctctttgcatatgtaagggtaaggctgcatataatattacaatatccctcccccttacctttacatagcgaggagtctctgggcaatgggatacaatgtttttttttttttttttttttttttttaattagcttcacttactcgcagagccatcttctttagcttattcattgcagaaaactgtttgagacgagaaagaacagcaggatccagtgatctgtcaggggcaactccattctcacatatccaaggatgacctaaacaggcaaatgacacaagtaacattgtcagacaacacattgaaacacaatattttgaatatttacaaagtttaatccttaaggaagttaagctggaacttgcttttgaggaaacatcaacatccagctaactattaatttagataggactatttcttcctgggtgagtctgctatagatgtggcaacgaccacaacgccagtgagactttaatcacctattacatctttaataatgaagataactttgaatgtatgagtagcacaggaaaagccaatttctaatgctcagtccctcaattacatctataataacatccactgagtaaccataacgacttagctactagtgcaaaagggcaaaacaactatgcttttgatatgagggtggtccttgctcatagtaattatcgttaaaaaaaaaaaaaaaaggaagaacatacataacacttgatgagcagtcaaccgttctgaaggctgagaacacagcatctttctaatcagatcttttccactgtcagatattaaaggccaaggatctgagtcaaaatctatatgtcccttcaatactgcatcaaatataccctgctgggtctctgaactccaaaaaggacaaaactttcagtgatgaaacagatgaaggacaggaaatcaaaagagtgtaggcagtaagatatacctgcccaaaatggcggcacgccactaagcaatatgtacagtatgacaccagctgtccacacatctgcttcaggcccataatgcttgaggagaacctcaggagcaacatagtacggactgccgactacatcagtgaaaacttgacctgaggcaaaggttaaatgaatatttaaacaacaataattagtattaaatggtgttccctaaaatcctaatgggaatacaaatgtatctcaataaaatattgtaatgttgttcttaaaagaagatataaagagaaaagcagagttgtttgttaccgaccgggtttgaagaaaacagagaggccaaagtcaattgctttaagagagaaatcatcatctttgttgaccaagagaaagttttcaggcttgagatctctatgcatgaccccaagggaatggcaagcctcaacaaccccaacaataattttggtcaactccgcggccttcctctcggtatagtggcccctctggatgatgcgatcaaacaactcacccccggaacaaagctccatgacaatatgaacatagagaggatcctcataagcacccttgatggtgacaatgttcttgtgaccagctaaatggtgcattatctgaatttcccttctaacgtcctcgaggtcctccttggaaatcaacttccttttggagatggatttgcaggcatattcaatggaggtagaattctcggtgcataaataagtggtgccaaattggccctgtcccaatttacgaccaagagtgtatagatcacgaatgttgggagtcttatggcctaagacataataggcttggttgtcgaggccgcggcgcatgatggcttctctcttggcgttgaagggaagattgctgttgttgttgttgttgttgttgttgttgttgttttcttgctgcttggttgaggagggatcagaatgggtggtggagtgcttggaatggtcttcgggctggctgaagccctgaatatatttccctttcaaagatccgcggcatgtgttgcccatcaaacaaaccaatttatattatatattcatccaacgatctcctctcatcagcttcttcccctctgctctgctctctctctctctctctctctctctctctctctctctttttctctctctctctctctctctgttgcgctcacctcacaaacaaatcaatccaaaaaaactattcattcatttctttcacatcacatcatctaatttcaacacccacccagacccagcagaaaagaatgcaatacaacaataaagaattacgaaataagcgtaccagaagtgaaggtgaacgacgaatggaaagaggaataactttcgcttctttcttctccgacagatctccacaaaattagtttccaaaattatttctattttttatttctggttaattttaggatgattggattggtggtggtattgtaatttttgtattggctcctgccgagaaacatcggatgttagtgctgaccagctacgcccacttctctctctctctctctctctctctgtagaattttcaattaaatatcacgcggctttctttttcatttcctttcttttttctttttggttcaattcaatgcatccgagatcaaaggggcccaaaacaagacaccaaatctttatcaaagctttagacgaaacttaccttttgattccctattttactaactacaccgtctatctaaaaattctaaattttatttccaaaaaacacctatgagtattttaaaaggtcaaaaccattcttcaccaatttttttctcagattacagcaccactccttatttcaatgcataaatgagagattaaaagcaggatgattttttaaataaaaatttgaacacttctatttaccagaattgagaatatatttagtaaaatatcaatctatattttaacgtgatatttaaagttattgcagccaagtaatggaaaatgtttcttattttcatattgattagttagcacgttgactttaggagatacagcagtcatctatgttagatattgttctaaaatcgtggaatctatttttacacaactatacaatttacatttacattttataaaggaaaaaatgtctcaaaatattctaaaatttaattttacactctttacaaattttatacgtttttaatatttatatttattaaaactgatgtatctttaatttctcattgaagactaaaaacacgtgtttttgttaaatggcaaggactaaaaacataaaaaaaaaaaactcataaggactaaaattagcatttcaatatattttaagagactaacaacttattttaactctttcaaaaaaaatattagattgggaaagaaaactaaccaatgactcgttccaacaggacatgagcaccatcatcaccattgaattctcaaacgaatttcattcatttaagaacaagatatgatttataaatctcaagtgtttatactaaaaaaacatcatgaaagttagcactaccataggtttgacaaacctctaatgtccatacttaaaggacatgcacataaagatccaaaagactttgttaaaattataatgtggccggccaatgtataggcaaggtataaaaagagatagtgagctagaaagaatagaggagaaataaggaaaataacctagggaaacaaataccaaaaaatggaagagagagaacatatcccatgaattccgccaattttgtttttaaaaattgacatttaatcaatagaataataaaaagcatttcgtaacaacactcattgtgaatggcgattctttgacatgtaagcaaatttggatgagattttaaagaaaaagggagccacagccacgggagtcattcattcacttataatctaccttttagcttagccggcacataggaataggatcggttacatcatttttcttgtcttgtcttgttttgttgagtcgaggtagttgtagacttgttttgttttacatcatttttcttttcttgtcttgttttgccgagtcgaggtagttgtagacttgttgtagtagtatatactaatactgtgccgctatgctagctacgcccaatatcaatcagttcagtgaataattttagaaaggaaagatcaccctcctgccctggccccaactttattattatacttttgttctatgtccttttatgcagtatattattcttgaaagttgaaacttccaactcaaactgattttattaggagagatgaagatggctttacgttctggatccgatctgtgaactgtgatccatcttcaatctttcagtaacaaacatgagcggagctgttcttgttgctgtggctgctgctatcggcaacttgctgcaaggatgggataatgccaccattgcaggtcatatttttattcggttagccaattaagataacattcaaccaagtctaattggctttctatgctatgcaggatctattttgtacataaagagggagtttaatttacaaagtgaacccacaatagaaggtctaattgtggccatgtcacttattggagccactgtcgttacgacatgctctggacccttatcagacttgctaggccggcgtcctatgttgatcatctcctctatcctttattttgttagttctctggtcatgctatggtctccaaatgtttacattctcctctttgcaaggcttttagatggattaggcattggtttggcagtcaccttggtacctctttacatatccgagacagctccacctgagattaggggattactaaatactcttccgcagttcactggttctgctggaatgttcttttcctactgtatggtctttgctatatcactcaccaaggccccaaactggagactcatgttgggtgttctttcaattccctctctcatttattttgcactcacactattcttcttgcctgaatctccaagatggcttgtcagcaaaggccggatgctagaggccaagaaggttttgcaacgactttgcagcagacaagatgtcgctggttggttatgcatttatttgatttgatttcatcagttcttgtttacttgcccttgatttggatggtaattgttcttggatatgatcaggtgagatggctttactagttgagggtcttggagttgggggtgataccgctatagaagagtacataattggtccagccaatgaattcagtgatgctgagcagatcaaattgtatgggacagcagaaggtcaatcctggattgccaaacctgtcactggacaaagttccattggccttgtatctcggaagggaagcatggcaaatcaaagtgctctagtggaccctctagtgaagctctttggtagtgtccatgagaagctcccagaaacaggaagcgcacttttcccacactttggaagcatgtttagtgttgggggaaatcaacctaggaatgaagattgggatgaagaaagcattgccagagagggtgatgattatgtatctgatgctgctgccgcggacgactctgatgacaatttgcagagtccattgatctcacgtcaagcaacaaatgtggaaagggacatgcctgctcctgcccagggaagcatgaggcaaggtagtcttttgcaaggagaacatgctggaaactcagggattggtggtggatggcagctagcatggaaatggtctgaaacagaaggtgttttcaagagaatatatttacaccaagaaggtggtcctggatctagacgtgggtctctcatttcacttccaggcggtgatgcgcccacactaacagatggtgagattgtccaggctgccgctctagtgagtcagtcagccctttacaacaaggagcttatgcatcagcagccagttggaccagccatgattcatccatcccaaacagctgcaaaagggccgagttggagtgacctttttgagcctggggtgaagcatgcactgattgtgggggtggggattcaaattcttcaacaggtaatgacattttttgaaacttctgttaatctaactttgatgaaattgtcagaactatttagacatattagaacattttttaaatctcaaaactcattcagtaggtgatctattcattagcccattgtacctagtaaaaagctatgtctgactgtcatctaactcctcttaaacatcgcagttctctggtataaatggggtgctctactatacacctcaaattcttgagcaggcaggtgttggttatcttctttcaaacctgggcctcggttctacttctgcgtcttttcttattagcagtgtgacaaccttgttgatgttaccctgtatagctgtggccatgaggctcatggatatatctggcagaaggtatgaatctttctcttatcattttttgttggcttctacttaaatggtaagatttgtttcaataggtggatgtatcctggagatgattttctcatggacatactgtttccattgcatattttccctgtatgttctttgctagaatattttgcaatttagggtggtattcaataacaaattgggtttgaaattactactattgcaaagtgctctcaaactaaaggaaaatgatatcaaacagtaataagatcaacgattctacatgatcagtaaatgagctgaaactaagtgtgttgtagatgagattgctgaggtgaatgagctgacaaagaaaggacaagattaggatttaggaatgtttttatatccaagggaatgttgaagttagcatctatagataggataatggaaactcgtctagtttgtgcgaagatcaatgaaggatccaatgagaaaagttgatcgaattgaagtgctctaattaaaagacaaagtaaaacttaggaaaacattaggagaagccattagaaaaaaaaagcagcttgcttttcatttcttttttttagttttggtttttgatttagctcagtggtgttgaatgatccatatacattgactccacctagtgaatatggcttggttgtggtggtcctggtggagacggtgttttgttttctattatttgtaagttcctatatgaaagtatttgcgataattctggaaattgtaacctttataatttggaaagtatttgaaagattcagaacttaaatatttgatatttgtgagttatcttctccttttgttgcttttcttaaccccttgttgtgtatatttcttcattgcttgtttttgttcattcaatctgcagtactcattggtgacatttttctatttttatttatttattcagaaccttgctgctgactacaatccccgtcttgatagtatcacttctcatattagtaatagggagtcttgtggaattggacagtactataaaagcttttatctcaacttcaagtgttattgtctatttctgttgtttcgtcatgggctttgggccaattcctaatatcctttgttcagagatcttccctactcgagttcgtggtctatgcatggctatatgtgcacttacattttggatatgtgacatcatagtcacctacacgctcccagttatgcttaattctgtgggccttggtggtgtttttggtatgtatgcggttgtttgcatcatagcttgggtgtttgtcttcttaaaagttccagaaaccaagggcatgccactggaagttatcaatgagttcttctctgtcggggcaaagcaagctcaagttgccaataagacctgactttacatacgacccattggatcttttttaatataaaattattttcaatctatggatttcttgttttgtttcctcttgaggcaccttcatcgtgggctgggatttgggatttgagaaatgagaaagtccaaaggaaactcgttagtcaataaaattataagcatctactataacattcgaatttgatttcataacccttatttattgactttataaaatgttatttactttttttttctttttttaataatacttattttagtccttagcgttagtgcaaaatattatgaagaaaatattaaaatatagtattttataaaattatagttttgtgaagttaaattttagacatacataatgtcaggaagtaaaacgagggtttatacatagaaattagataaacgttcatttttaaatcttgttttatgcggcagagatgttagggaaagtaggaatttttggtataacaaaaataggaacggaaaattttaaggtgtctaccatagaaattatagtcaatgttaaatcctttttataagaaaggtagtattttttttccttaattataaaaaacatttttaatttttgacaaaattataaaaaaaaacatataatcactttaaaatgtattaatgagtaattttcttttatatccttgattcattgtgaaatgaagatcactttttttattataaatagtgttattatatctaactaattcttaaataagttaattttatgagtattttttttcaaaaatcttgatatgaattaaaattatctaatttaactacttatattgatcttgataaattggataattatttctagtatataaataaacttggtatttgtttatatatacagagaatcgaaagtaatataatcggaaattgtgttaagtattataaatattttgaatatgttattattttaatgaattaaaaccaagcattagacacctagtcaaattaaacatcgaatctattttgacatgaaatatcaaactaattaagcacaagatcaaacttgacatcaaacaccaagccaaccaaatattaaggattcgtttggtaagagagtaaacgagaaaaaagaaaatatgactaacgaaatattttcttatgtttgtttagatagaaaatgaaaggaaaaattattttttaataaaaaatttaaaaattttcttcttttcattttctttccaattcaaattttaaaattttccttccttccttatttttcttccatctaaccaaatataagataagtcaaacttaacattgaatatttaactaaagtaagcatcgagccaaacttgacactaaacaccttgtcaaactaagcaccagatcaaactagatattgagcacctaatcaaactaagcatcagactaaatagacacctagccaaactaaggaccaaaccaaatttaatattgaacacctagccaaactaagtattggactacacttacaccaaacatcgagccaaactaagcatcggatcgcacttgacaccaaacccgatgaaaagatttaatagttaataaaatttaaaatgaaattataacaaaaaaaagtattactgattataatttaattttgatatgttgtcaatattttttttatagtgttattgttatattaataacaaaatttgatttttacatttaattatttgaaagttacatgtttctaatttgactgcagaatgtataaagcatgttacgtaacgtcaaaattaaattgtactgtattacacatgcttatagttgtgtaaacatatacgataaatataaaatagttttaaatatgagggaaaaagccattacatttttttaaaataaaatcgtatatgtttatatagttgttttagactgtacatctagaattcgacccttcaaatattatgatgttttattttcatttttgttaccaaattgatttctagtatttggaaacactttatttgagagaaaaaataaattcgaaagttttaccaagatgtaaaaaattctttaaaacatcttaatttaacatgtattaagatcatgatactaatcctttatttctttgttgtcaaattcatttcataaaaatttaaaataatcactaaatttggtgttattaatttaaccatttgaaaaaaaagaataaagtgatattttaaatttctaagtaatttgatagtaattttttttaagcaataatattataattttgtaaaagtctaatttagtaaaaacgaattgagaattaatgtgatgactacctattcgttagaagatgacctagtttaacaaaggtaaaattagataatgtttacatatacctttttcttccttcaatgttcaaatacagtaagttcaacaaaatctttaatacaaacaagggtaggaaaaagtgcacagattctttttcaaacttattcaaagaaaacagaaggaaaacgcggtaacaaataaacaatgatcgatcttcagctcatcataaaacaatggttctttgagcaaccatacatataacctaggaacgagctttcgaattgaaatccgtgatgaaagcctccatccacataaactcttagattaaccaagaaagaattagaaaacattgatagtgacatgataaagagaaatattaaggaacaatacatgctattcaaaagctaagattaactagcgtaatgaaacaagaaaagactaaaaatgacttctttttgagctttgtcaactcaagtagcaaaacaaaagcaaagaaaatctaaaacatgcttttgagttcaccataacactgacctgatctaggtcttttcataattattcatctatttaaatttccaccacccaaacagagctcccagcttggttttaatgtttctctttttattcagacctccacactagaatgctgcttcattgatcagatcaaatttcaaatacatgtgtgcggtcagcacttagggtgttacgagcaagttggaagaaatccggatcttgaaatctacaagtctctctctggcaagcataataaattagaattcagtagctgatacaaaattgtcaaccaaccatgttgtttgttaaaaacatatatacgaataagaaaaggccgtgagatgcatttaattagaaaatcacaatcaatttcaagaagcttagaaaagaaatgaatgggggttgagatgagaagaaagaagtaataatgaatttataaggtagaccttgtgaaatcataaggctagttaaaaaaagtagcaataataaagaagattagaaaaggccttggttgtcgtatgaatatcggttggagaaaagtgaagaattgggcaaaatcatatagcattaggaagaacagaagcaagtaaaagtataaaacaagcggtagagaagtgaagcgtaccatagagatagagaagagaaggttcaatttggaatgcgtctagcaccaaggcgatcaagctgcttgacatatgcagaagccttcaaattgccttcatggagaaaagcgtcaatcatgtgtttggcaatgaggtgtccaatttgctcgtcgtcaatgacggcgacggcggtagggccggcgccgctgatggtacagccaaaagcaccggcctgaatggcagccctcttgacagcctccatgccaggaatcaagggggcacgccttggctcaacgatcttgtcagaggacaatgccttccccaacccaaccacgtcgccctgcagcaccgacgccaccagagcacctgcctggctgcagttccacacgtggtgcggcatcccgatctccgtaggcagcgctgcccgcatcttcttcgtcggggcctcgaactcaggcgtcaccagcacgaaatacagctctttctccgccggaaacatcaaaggcatcaactccagcggcgagtagctaccgatcagcacaaaaccccccattatcgacggcgccacgttgtccgcgtgataccccgacaccttctcttccgatttcagtgatgccagaaccagctcctccacgcctaatttcttcccaaacagctcgttcaccgccacggcggccgcagcggcgctggcggcgctggatcccagtccgcttcccaaaggcaggcccttctccagggagagggagaggccgacggatcgaatggagagcattttcatgacttcaatggcggcgatgccggcgcagttccagagagggtttttgctgagcttgttgggggcgtggccgctgatgtcggatatgcatatctcgccagggtgaacctgtgggtccaccttcaccgacacaatgtctccgagtccgtccacggcgcagcctaggaagtcgaatcccggacccagattcgccaccgtggcgggagcaaacgctttcaccaatgtggttacaggttcgggctcccttcgaatattgactgacacgttgctgctgcagcatctgattctgaatctggccctgcctttcaaactcgccgtagacggacacaggaagcacgtcgtcgacgtcgccatctccactcttgcgggtttgtctcttccaaattataatcctaccaactacgattcaagtaatgtatttcaattaaatttaaaatttccttttttactttgtgtctttgtttgggtcattcccatgcccaaccaaaacaaaaattgttggtactttaattgggagtccatagttttgctgaaactttctaaaattaatttagaatttttaagaaatatgacgaaggttttattttaaaattaagttagtaacataatttaattttttttactcaacttaaaaattattttaaataagtattaattctaaaaccaaaatcaattttttaatctaaaatcagttaataagaattttaaggtaattttgaatgatataagatagatccaattacttttttttctttcaaaaactaatttttatctgcccatttttttaaaacaaaaacttaagatgatattaattgttattattttattaattatactcttaccattatctattttttaatatttattttatccatttattataaaataattcaatttatcgattcaattaatatgttacattatcattctaattagtattgacaaatacatcacatttttcgattaacatatttaaaacaaaaaaaaaaattgattaaaatgaaacatttcaaaaacataaaaaataaaaataaaacttttaaaattttatgtaacaaaactaaaaatattaaaacataaataatcaaaagtatcatttagcttttattcattgaaaaaatattgctatagtatgtaaccgctaaaatcaagttgtgtaaatatgcatgattaaacgaacacgtttaactataaatgtttcacactagcttgaacctagatgcaagtaaataatctgtaatattactaattaattatgagtgcttatatatcttcaccagaagcaagcagaagttttggcttcaacattaggtgagtgaggtcactaaaaatgtctggatgcgtgctgaacggagctgcaatgattagaaataccaactttttgaggggttttcttattgaattgccgtaccattgatgaaaaaaatagacaagaagcgccaggaaacatgttattccacagattagaaacaggccccagaagctctttaattgaagttgttaatcctcagtactgtgaaaaccacaagccttttctgaaagccacttttcatggatcctttgaagttctccattctcagatagggttagaatcgcagttgacatatcaattgcaagaggagtctctcgggaatgcctgccgtgacacctaagaaattaatcaaagacaagtagtaacataaagatttacaagtacatgaattgcagttgagaatcatctaggatcgagtagtactgaacttgagcaaaatttgtgctcaactaccatcaacatatatagtgttcattgtttcattcaaagaagctaaagggaagcgaagttgtgatttattgcctcccattttataaaatatcataccttctaacatcatgttttgctttctgcattagtagttagtgcaacaaagtacataaaaaaccacaccctgagaaaagtaccagtaagtaattttaaaaaatactcacaaatccccatccacttttggtgaactcctggccccttattgagaattggcagtggtttgaaaggaaaagttctacataggatcgttcatccactacagctgcaacagttccgctttcaagggcgacagcatattcttctggtgagcgaagaggaacaagtctatgtttagggatgttgagttgctcagtgagatagtttgcagcaaatgagcctacttggaaccctatacgttcactgctggatatcaagctatcaattcctgttattggtgaggacagctgttgcacagtgagaattgatgtcaagcttgcagtgtagcttgaattgattatcagaaccacaaaaggccagattatcaacacaacactaccaagtggactaactgtgttttctcctgaaacaataataaagaagcttatctgtttctagccacaaacatgaataggacatgaactgtcaaaatgggtggacaacttactgtgcgcaaagaacatggttgagaaactaaacctgcaacagcatacaaagatgagttatgaccagactagatatgtgcacaagctacaagagtacttaccaaagaactgtaactatctgttccctcggtgacccccgaaactcattgtttgttctatgttcaagaatccacaccactgctccaacaaaaaggaaaaaaaatgcagtgacacactgacaccacacatctgtggagtaaatggttgtaacatcccgggcgctgacgagcgcggggagtgatcgccggtgcagtgaggcacggacaaggagcggctcctggcaggtaccagcgggaggggtacatgaatgaatcaaatacacacccaaacgagagggatccagaggctgtgcaggtatgggactgtacagttgaggataacttaaaggatttaataggtactacctataccaacaaggtgcatctacttttcggtagcccataacataagaacttcacagttaagcgtgcttgacttggagtaattatgggattggtgacctcctgggaagtttctcaggaagtgtgtgagtgaggacaaagcacactgaaaagtcttgtgttggtatgtagggacgcaagtggccgggcgttacaagtggtatcagagcaaggcctctctaccagtacggtgtggttcgaggacgaaccaggcggaagctggtgggcatgtaacatcccgggcgctgacgagcgcggggagtgatcgccggtgcagtgaggcacggacaaggagcggctcctggcaggtaccagcgggaggggtacatgaatgaatcgaatatacacccgaacgagagggatccagaggctgtgcaggtatgggactgtacagttgaggataacttaaaggatttaataggtactacctataccaacaaggtgcatctacttttcggtagcccataacataagaacttcacagttaagcgtgcttgacttggagcaattatgggatgggtgacctcctgggaagtttcttaggaagtgtgtgagtgaggacaaagcatactgaaaagtcttgtgttggtatgtagggacagtcgttgatcctgcaagtggcagggcgttacaatggtcgcaagatgcaagtgcaaaaaaatcgatatataaaagcaagatattactacattatgtttgttctctgcagtgagcattacttacatcagaagtaatcatgttgataagatcgtagtagcttgggttcttgtgtccatctccaaacagaatgaactgttattgaactgcaaagggaagcaatttaacggcagctaggaatatatctatatgcaatatccttgaactgcattggtgccatttatttgcgagaccgtgtcttgatagctaactctgttgagaactccaattctcagttgcctcccattatttgggaaaacccatccacgaggcttttctgttgtatttcctggccatatgacaaggtttagatgctggcttgaaattgaacgattggcaggctctgcgtgaagtttctcaggggttattatagagaggccagagtaattagaccagtagccgatactcctataacctgtagcaattacattaaggatgtcatatgatggatttagaggagatctatctgaaccaaattgaataggtccagtcaatccagtcatattaatgcgcaatatgttatcaagtaactgcttccctccatcaaaaacgctcaaagcaccgaaatccagagcctcttccctcgtaccacttaagtttgtattgttagagaaggaaatggtaccattccgatcaaaaaaaaaaaaaattgagtaccttagcagtcatccaaacagaatcatatgcatagaggccgtatggatttaacccaattgagccattactgatgtgtttccaccttgagataaatgcctgtttttttctggattgaggggtgtgagggcaaaaggtaataactccttgaattgagttacaagtatctgaaggtagtgaagtagttgagtctaaaatagttgataaccaagcagtagctatccagacataccctttggtcatcattcctagcttttgagccacctcaaaaaccaacagaccagtttgcgcgaaggtgtttaagacgataacccgagactccatactcttgatcttcactaactgaccagtaacaggggatggagtggcagtcggatcaggaggcagtgctgctttgtaagacaacttacagcgtctctcagcaagtttatccccaaaacggttatcccattccgactctgatcatcgtcgctgaaccctgctatgacttctctccaaccaaaatagctaatgaggtcggcaacggcattcatgtggaagtgatcggtgggtgctgtttggagaaaataaggatactggagaggtgttagggtggggtccagagccgtggagaagagtaggggaacatggagctcatttgcgagatgcgaaagcacatgggccattactgaagattgtggaccaattatagctactgagtcggtcatcaagaacttgagggctggaagaattaggaagtaaatgaatatatataaaataaaacaagcaagcaggagcaggaagtgatacatatacatacccccaataaagccaagaaaaccactgaagttggaagcatggatggttatggacaatttacgtcccaccaggatgccaggatcggaattcacatctttctcagcagcttcgatggcaattttggaaactcgtccgtttatagttttaaaagtgaatatggcaccgattttgacgacatcatcatgtcctcttgatgctccatgtaataggatcaatgttaataatgcaacgcatagcaaattcatccagaaactatgattcataattatatatgtaatgtagaggaggtcgagagagaggctactactgctgctgtttgatttgaatgggaagtatagacagacaatatgaaggaatgtagagtgagtggtgaagagatagtgatagctttaactgtagcgggaggcaatgaaagcagaaaccccacgtcacgcgggtagagggccacgtccaacacagtaagtgggacggtgtctgagtgagcacagcaagggccattttgactgacatgaatgcaagcagattgtgacgtttcatttatcgtacttaatttcaacgtttcaagtttgtacaagaatatatctgtgtccttgctatctcgacagctttcacactttatgatgccaagaggaatttatattttctttttggaagtttatacatctttccctctgaatgcatgtatgttttggtttttcaagtgagtttgggtacaagtttccaactctttgatcctaacccagaaactttctatttaaagactaagttaggtaataatttatgaggggattacacatgtacaccaattataaaatatgattaacctaccaaacgtcatattactgttaccaacttcatcttttgctcaaggactcccaattaagcaatatccactatgaagtaattcaaatggcataacttagacgccaacaaccttggtgttttgtttgagtttttagcttcttcatattcatgcatgtaggttaaaatatgattttggtcctaatatttaagtctcttattttataaaatggaggattttgatcccataagtctcaactgacgttgacgattaaataaaaaatgctgaccattaatttgttaacgtgacactataatattaaacttttaattaatgttttgatcacgacaaaatttaatttaataaaacttaattaaaaactaaaatatataaacaatttttatttgttcagtttttttattatcttaattaattaactaaaaactatacacctttaaataaaaaataggcatgtcaccgcagtcaacgctaaacatatcagtcaatggcctgaattgatagttgaggccaaaattctcaacgtagtaaaagagagagactaaatatttttattttttataaaatataaagaattaaaattgtgaattgaataaaattagaggaataacttacatctataatttgagactgcagcctccatcccattttggttccaggcttgaaaatttggactagtcttataaatgctaattattgaacctctaacaatttctttgtttgcacattattatatttcttgttttcttttaatttttgtagattcaaccatactctactttactcgaattatttttcaaaataaagagtaggtttaaatttgtttaaatttcttaatgactaagcaaacaataaatttatagatgatgacaatttagtttactgcatttccttttaattttaaaatcctccacccaaatacaacataatttgatcagtaatctctccaataagaacttactacaaaatcagaaccaaccccagagttctgacgaaattagattgaagaggaatgctattaatttcagtcactaataattacgtgaaataagttcagttaataatgaaaattgtgttaaaaagtatattgtttacatttcactaaatttaattggacaaattaggttcaagttatacttcaccacatatatgacaaagaatcataataaaattccgctcagtaaacaacactcaaatcagatagtcatcaataccacaatctcttctacgggactatggaaaattaacaaccaacaaacaaaaaatatagacaggccttcactttcattttaagaagggaagtaagattgctggactggggacaaacctgcgcccttccctaaagaaaaagtgaggaacaaggaatacacaagattaaatacaagaaatacattacacataacaggttccagatagcaagacagacaacccactccaccagaggcaacagtcggaaagtctgaaaacagaaagaaataatgcatcgggtggaattcctaaactaaaaagcactccaattatcagatcctcgtcttggagtttcattatcagatgaagtcctaaacgggccagagccaaagggatccgagtcatcaaaagctggaaacccatgagcatggtcaaaatccacactgttgcgtactgaatcatattgttctgtcttctcccgagcaggcaaagatacactatcatgtgttctgaaggaatcaaatcttgagaagtcaaaagcagtttccaaccactcttttggcctttgcggagagctacctgagctgtaaagtggtgtgcttggaacagaatcatcaaaactgaatccactgctcctctggaagacatcaccagcctgtggtgaacctgttttgatggggtttaagtccagttccccagaatcaaagaaatagttgttcccagctctatcaagatctctctccttttaaaaaaaaaaaaatccggaaagtaatgagtagattgctagagtataaatatccattgatcaaacacgtacaagcaactcaaaatgttaaatttaagaaatatattaccaagtacattaacagaaggtgagggttcagtatttttagtcaatcttcaaatatattcaattatatatctttgggctggcagatctagcacattcagattacattatgctttctcctctgatcccatcaatcctttgcaaactggcttccatacttttttgcaaagaatgacacatctatccctttgattttaagacacaatcataaaatcttataaaagctctgaattcctactaactaaatcatcatgtcttcatattccatcacaagtatcacgtaatgtaaccatttagatctccttaacatccaagtcatattctgaacaaccacatggaggccaactaatgcttggttcgattgaaatctataaaaggaaacaaaagaccagcacaatcttcatttatctggaaaaatcctatgatagggtaccacaagaagtccaatgtaaaactctagtgataaggagtttgtattttatataataaaattgtaaaggatatgaaatggagttatcaaaaaaagatttccttacaaaataggtttgcaccaaggtcaatttagagtccaactttttatcttaggcaataaatagcgagtgaactaatagagttgtaatataactgtagtcttgcaccaagggtcaacttttcgtgcctctatcatggtattgcacatgcttattaggcacaaccaagagtcaatgtctcaattatggtaattaggcaattgctgcatataaatatccttaattatggtaattatgtaattctatgagttacataattatggaaattaggtaattattttctctttaattaaattattaaacccatagaccataatatataataatacaccccgctgtgtacactaacacatggattcaattatgtatcttactttttcttcttctcaacatcaataaacactttctacaaattatatatatgggtctgtttgtttaagctcattttttaagaaagcacttttttaataaaataagcagttttcttcttttctgatgtgtttgtctaagctactttttcttaaaataagcagtgttctgttttttttaagaagcaaatcctatctacttcttaagaagcgctttcttataaattgttttttcaagtttaaacaaaagggtctgataaaaaaaagtttaaacaaaatggcccatagtcctagttgacgagtgaagaaaagaaagaaatatagtaaacttgaattgtggaggaagactaccaaatgaaacatgatcaaggttttgtctcaaaattctgttttgaatgggcctatcttaactgcaaaagctagctcttgaaattaccattgttcaagcccttgttctactatggttgtatctatagtcgatatcggatctcaacaaatttgaggtttattcagtttaaagtttcacaataatgtgttatagataaattagaagaaatttagtgtatttgagcctttctctatatgcttttgtcaataatatcttgattctttccaaatatgcatacctcaaatgatgatttgtattaccacattgactgttctcaatagtgacaatttcctagtatgcatctttccagtaatattttccttcataggctatgtaacatcttgactatcttccagatgagcatcattctaacaatctaatcactatgttgtctctattaatgctcttttttggtcaaatgtatttaagtcattgtttgggaaccctaataacattgtgtgctttggtgagcctatcaaagtttcaagatgccgacatactaatcttcaactagggggagtgttagaatattaggaatatcattattgtgtaaagagtcttgtcatgttacttatacaacatttgttacttacttgaatattagcattcattgctgtattagaatatagtgttgggttagtgttttcaaaatattacatctcaattcagttagttacatatactccatatttcaacaaccaccagtggtcatgacaagaaagaatagtgcaggagaaatttaaacacacacacaaacacctatatatatataactggcaaacacgtgttttgaaataaaaaataatttggccaagacattaaggtgtgagaattggcatacctctttagtgaagctactagcattgaatccccaaactgaatcaatatcatcatttgtgtcaaaggttccccaatttggttcatcaaaaattttgtctccagaaaacgcagatttgacaccaccatgatcactacatatgcaagattatatgtaaattattttgcatcatcaaaagatccatactatgtgaaaatatgaaacaaaatatacattggtatctattaacactcatgtatgtcaaaatcaatttcaaaccaaatttgggaattaaagtccgtatcatgcactagaaatgttcataggacgggttgaaacaggtttagtttgatccctaaaaaaaaaaaaaaactacataccccattgctcggaggctccacgctatgcgcaggtaagggggagggaaattgtacgcaaccttacccttgcatatgcaaagaggctgtttcgggattcgaacctatgaccaacaagtcaccaagacacaactttagcttcatccttacctagttaaaaattttaatagggtcatttgatagaacctgaacctgaatgtgtgtatgctgatgatagtatcaccattcaactatgacttgtataaaaaaatatgatagtccaaaatctataaagtgatgatatacaacaatttgtgactctgttaaacacatcatatgagagatgacagttatgaatgactcttgaaaacttgctaaccgtgggtctctatcacacactcacataaaatccctttgagttgaagcatggaaatgcacaggctcatttttccttgtgctaaagttataatatgattgaaaaaaatggggcagcacaaatcaaacttttatccaaacagtaagaggctgtaaaaccatgtcaaggacaaatcttctagaagaataagttgttgggtgtagaccaaggagtctttaacgataatgccaccgtatttgtcaacatcaacatcaacatcaacagcacctttaacccaaattaattggggtctgtggtagatgaacccaatgatagattggaaaaaaagacaaagaaagagaaagggaaatgggaagaaaaaaggaaaataagacaaaagaaaggaaaaataagctaaaatagaagaaggatgaaaggaggaggggagaaatgaagaggaaaagaactaaaaactaaaaaaaaaggaacgactggaacatatacatactaatgggtttaaccctccaccaagcttatagcttttatccactccatcctaagacacatcgtccgccaatctatatcccactctattaggtcttgtttaattacctttccctgggtgagtttcggtcgacctctacctctctttgtgtcgacttcttggtaacaaacttttgttctaatgcgagcatccagtggaggagtacaacatatttgtacaacaataataataatagataagggatcgagttactataggaggagtaactctttgtaaagttactcccttcaataactctatatatcaaattttattaatccaattgttaaattaaaagttcttatttagtacatcaagtctacaattttttataaaattataaaactatttgatacttcgttaaataaatttaatttaaaatataaaatatttttgtaaaaatataagtaaatgttgagtataagattacataactacaaatatctgatttatataaaacttgatgtgtgtggtcattgaatcaatatctaaatattcaatggtaggaataataaaaattcatataaacaaaaagttatttaagacactaacaaaaacaacaacaacaatattgatgatcatattattattattaaaaataccatgaccttccaaaggcataaagaatattaatggtcagcaaaataagaggacgcctactaaatatatgatcaaatgagcaattggccagcatttgggaaactggtgaataaatcttaaaaaccatacctttgggtttcttgtatggtatcttgatcacggagtaagctatcttcaccagctgtctttctaatgtcagaatcaaaatccccatgcgggcttccgatagcactgcttgcaaatggactattgggagcactttttacagacccatcatcacttttattataaacaaatccattgccaactccctgttcattggtagtctggggcttttctgacttatcatcactcttgggagaagcagcaaatgtaggactgtcagtgctcacagcttccgcgttcacagctttcgtgttcacagctgacggcaacttttgctttggaggcgctataatgttttgcacgtcgagagtgagttctttgacaaaaacaaattctgcaagaatagtgaataacaaaatttatttagtcctttccatgataatccaaacaagaacagatgcaggtcagaaaataaacaagtatcagttaaccgttatttcaattcaatcaatatcttataatatctcttaaatatacacctatttttggaatgcattgtctcctgaactacataactgttcaaaattgatcccttgcatttagatgaacagctacacttagaaaataatgacacaacaaagtacagctaagtaaagttcatcagcaaacaaagtacttagtgtaaaagaaatatagatataagagaggtataggcaagcagagaaagtgatagaaactaaggtctgtgagtgcatagaagagagaaagcgatagaaactaaggtctgtgagtgcatagaagagaataatttacaaatagaaaaaagactggccagattctattgggtcttttgatgctgcaaccaattgtaaaacttatgagtaccaaatttcattatccctcacccattaattatttacttgccacaaaggttgcagatcagtttgcttagtcttctgatattataattttctttcagctattaaaaatgtctgtcatgagtaggcatgccttaagattcagctcttacctcaatgttgcaatttcttctctgatctgaagagatattgtctgcatttatttccttaattattatctctatattctttattttttgtatttgtggacttatcatcaattaggttgaataggttcataaaaaataggaaaaattgcaattttggtccccctttaattcttgatctgtgattttggtccccacattttagaatatccataattttagtccaatcctcaactttacatacattttatttcttttattttggcccaaaataaaccctagatctaacatattaacttaaggtactatcaagtatcaagaaataatttgattaattaaaattaaaaaataaaataaataaatgtatgcaaaattgaggattggaccaaagttgcggattttctaaaatgtggtgactaaaatcgtggaaaaaaattgggggtccaaaatcacggatcataaattaaaggggaccaatattgcaatttagcataaaaatattacataatttggtaaatttgtttatataaccctctatttcctttccctagttcattgccttccctttcctcccaactttcgaaacatatctgatgtgattactaggactaaaagtgcaaataaccaaggaagaacagtaaaaaaatgataatgcattaaatcataatgtatcacatatacatgctgtcaattttattaatgcggaagaaaatacagatggaaggatgaaaaacactaagcaaaacaagaaacaagtaatacagactttaatacttcacaaacaagttttctttttgagatcaaccccttaaattataagaatgacaaaaaaatatccttatcaaaatgcaaatgaaatccaattgagtttgatgatacagaaggtaggcagataggcatccaataagagcgtataaaataaaaatgtggtttcataaccttgtgcaaaaattcctcgtaattaatgatggatgccacataattggcacagcatttttatttttattcaattaacagattatcatatctagttagggttattttggatacctttatcttcaagcttatcccaatcttcatcccagtcagcagctccttcttggataccaggttgccagccttacaggataaaatggagtgaggctacagaatacaacaaactcgatatgcacataattattgcattattcaatataatatatactaaggggagcacatggggtttgtgggcagagcaccacaaagcaaagagaaatgatgggacccgactaaaatgagcaaaacaagaatacatgataattatatccaaaagctaacaatgcacttagcaagtaagtgaacaaaaaggaagcaagttcatttaacaaaaatgaagagacaatttgtaggctataaaaagttttctgagcttctttaggagtatacttacccggtgtaactcttccttttcttttagtcatgttgtgagtctaactatagttggtagttagactgctattagttagacagttagttaggacagctgtttgacagctgtcactaactaactcaagttagttgacagttacataactataacttttgttttcttttgccatcaagtgggtttctctagcttgatctttggcaccttaattcaggttttatcatgtattaggttgccaaagctttgttaggcttactgatggccttttctttctttttcagtacttcttgtacttcttttcatatatataatatattatctttgctgataaaaaaaaaaatataaactgtattgttctcagtttctgtttgggttgaatacaatattctttcacctcaatttagttctctctcagttttactttcagattcatttagcttcattaaaatcatgatagataaatgcaatcatacagatacagaaagccaacaactaaagttttttgtcagagcaatataaataaataagcattacttaatagaacaccaccaatatcaattaaatcaaatgtattgaagatggaaatgcatagcatttcttgcatactgttctcagaaacatcagagagtttcaagtttcccttcttttcataaaatcaatgcattaacccaacatttgatagcaagtacagtagcaactactacaaagaaccatataattatataagcatcaatacaaagcatcatcatatttcttagaatgtgggtttggccctaactcaaccccaaaagctagctcatagggtgagggttgttccccacttatatactctatcttgatgctatctctagccgatgtgggacttgggttttccccaatacatcccctcacgcccagcacttttgggcttggtacgtggataatatggtgggtagcccgttaatggatctaagataagctctgatgccatctaagaatgtgggtttggacctaactcaaccccaaaagctagctcatagggtgagggttgttccccacttatatactctatcttgacactatctctagctgatgtgggacttgggttttccccaataatattgtatagtaaattgattccctaaaaaaattgcacaagagaaaacattcatgataaggagcatttcctaaactttatatattaaatgccacttgattaggttatacagtttattctgattttatgtaacctttaactgattgtttacaaagcatcatcatatggtattttatagagcttgtcaaacagagctttgcaacaaaatcagttaaaaattacataaaatcagaataaactgtatatatttaatgccacttgattaagcaacctgtatcaaatttcactggcagaaataattttactgctgattcaaaactagtaattcagcaactgaaggccagttcctcaaattacaaaacaaagctgatatctaaaacaaatgcactaaataccatataacgaaatcaaagacacgaaaaagatttgagaaggactggaagtatataacaacaccaattataaatttgaatttaccaaagggtagctccaataatgtagtgggtttagcacgtaatccatatttcttgcatcgctcattcagagatttcaccagctcatcaaggtctgtttgaatacgatcaacatgagcctgaaaatttcagatgactaaatgagatacataagttgatcacaatttctcaacatggatgcacaaacctggtaatattaaaatgtacctgcagagttgcatcaccttttccatcctgttccatcttgacaattgcttggtacaattcaatttttttctcctacacaaaaaaaaaaaataaaaaaaaatcatttgacagcaatgaagcaaaacaggtaaaaaaaaaataacaaactttttagcatatatgcttataagctatcaattgaagataaagccatatttcattgcacctgtatgtcacgaaacgtggcttcctcagtagttaacttggatgataaatctcctacttgcttatatttatcttcatatttctttgctaaaatgtcaacctgaaattcatatattgagcaaataataaatattatgattattgaggtaataaaaacacatgcaattctaaagaaagatacctcatgcttatcagcagctatcctttctatgacctcattaagacgattgtcacatctgcttttgtacagaaccttttattggcaaaagaacaagtaatttgtttaaaaaaggtgaaaagaaaaagaaacgatgaatattaagtattaacctgacactgacactattaaccatacgaacaaaatggaagatagcttttatatgctttactcttctaggtatccacaatttcatagtacaaaagggttacaaaagaacatgtctgtttcataggcttttttttttccagtagttcctaggtatctgcagaagcagacaaaagctgaaagaaaagggatagcatctattaatgcataacaattaagtaaaagacctttccaagagaccctttttcacttccttaaaattaataggacaggaaacccaagaggcagacaggtgatatgtaattatgttcagcagatctatagtaaaaaatgattagtttggttaacaaatctggatattgacaataagaacaaagccatgggatgtaggaatatgttcttatatatacttaaaacaatctgcatatattttgcacccttaaagctttgacagtaaaatctctttgtaagaatgtaagatgcattcttcctaaagtacaataaatcatgatggtgaacaattttttgaccaaaatacatttcacaattactactactagctacatcagtacatctatatggtatatagctcatcctgcaaatcaagatacagtataaatgtacacaaatcaaatgttaatctgttaagcatattctaaaataaatctaaagcttggacagctaggcaaggcgaaccctgtacagtaaaagtttcagctattattgatccagttgccacctcttcaccatgtttggatgacataaaagagactaaaacagtacaaaaagaactcagataaaccagactagagttttaaacctcttttatttaagcttcttttatttttttgaagaaaaagtgctttttaattaaaatggcatcttaaaagaatttacaatgattatattattgtaaattttcaaaaaagaaaaacttcaaaaatgctgctctagtggttttctcagaagcaaaaaagagtaacttctgaaagaaagctctaaaacaatgcatcacagaaccactttttctatacacaggccttaataaaatacaaaggaagtaagcaaggaaaacactcacaagttcctgcatttttgcacggtaaaattctattttctctctggactccttaatttccttctcaagttcttccacctgcatttaacaaagaaaatgaagagatgagaattgactatgttcaattgaaccacaagaattttatcaagcatacatggaccgcaataatgatatgcttcatgcaaatgacaatctacaatatgatctttccacgctatcttcaaagataccagtaacagctaataatttttgtagctgtaagtttcaatcatcagccaaaaagagtaagcatgcttcatgactgaaaccaaaaataacttaatgtcatcacaccacatcctcaaattaattgacctgaaaagattatcatagaggacacattccccatatttgtgatcgcaaagaacctactaagctgaaaggtaacttttatcttattcctatattactgaatatactctatctagagtagtgaatgttgaactttaaagggacaataaaagaaaaaagtgagagtaaaagaaatgataatattaaaggatgtgaccacagaaaaaagaacagaatatggaatgattgtatatgagattatgaggagatattaatgtaacatttatcaaggaaaaaatgacagaaaatttgttaaggtggtttagacatgtaaagaaagtcgctgaaggcaccagtgaagagagtagatcgcatgacttttagccctataaaaagtgcaacagcagaaatgattcaaaaaataaataaaagcaccttcttatcagcttctgttgcttcttgaaactttgaattaattgaattttgctcatctgaactcagctgattaatgaggtgcctctccaagactggaattctagatttctgcggcttgttctgaggtccttcatccgactgagagacagcagccggccttggtggccgacctgcagcagggttcacttgtcgagcaccagaaccagttgtccctggttgttgttgaaaagcttcaaaagataaaagggggcagagacacaaaaataagagaaaaatataaatttatcatttatctgaagggttatatcagtaataatctacaatagtggtattgtagtagtagtagtagtaaaataaaacctgctaattcttgggcacacacctgatggatttccccaactactatagtgagcagcaggttgaccagtagttggtaaatcaagcacaatgttacttggaagtacagctggaagaacgcatccttccctgtgtcgctccattaggtacaatgcaatacaaaactccctgagagaaagcatgctatcattatcttgatccgataagtcccagacctgctttaaaacctctgaaaaatataaaacatggcataaacataatgttcaagaaattagctagccatgaaaagtaatacacatggaggatgtgaaaactaaatagaaccccccaccccaaacagacacaaaaaactgctatcaaatccaacttagttcggaaatatgtttaattaatcatatttgagttgatttcctaatgcatgtagagctagaacactagagaagtagaaaaatatatatagcgttttaagccaactgtccaaacaaaaaggcaaggaagtagaagaaaaatacctcttggtaatctccaactaagaaacaagttccgcgcttgttccccagtgattttaccatctctatctgtgtctacttccatgaatactttcatatatttctggacatcagtttgagtcatccttggccatggagcttgggattgactggaagcagaatcctgtaatctccctggaagtccagatgaattcggcatattatgcgtctggagtgaggcatgctggtcctgttttaccaccagctgggcttgctgaagctttgcaccaacaggctgggttgcaagtgagcgctgcaaagaatcaggagtactagtcctagtagaatgctggtttcctccagatacaggaacaatagctgaagaaagcgctgaagtgccagaagaaaatccttgtggagaagaagcttgcttgggctgaaatgagctagctgagaataaatctcctccaaaaaatgaatcggaagaattaccgttaacagaagtatccactggtttagaatccttaaccaattgatctgatgactttatgggggaggcaggatattggccaggtggccgtgccacatttgatccaaacccaaacccctcctgcgttgatgggggactagttcctctaactgctactggagagaaagttacttctggagttccacccatcttgccataactggaaatgccgggggtttcagggcgagccattccttgagtggcaacagcagctggaggcctcgcaaactgatttccctgagaagggagggtttgctggttaccactcaaatttgaaactgccccccttggtccaagattttggtgggataaaggactaacaggaccaatctgtggcgcaggtccaggtgcaggtgcaggcgcaggcgcaggtgcaggtggagatactgtggcactgaaattaatctgaggagcaggaatcttagatgcagccgggccatacaatgctgcttttaccatttcgggagttagttcccgcttactctgtgccacagtaacaagcttaagggcattgtaaaactctgcccgcccaaggaaaccactctggctttggtttgcaaatgcccaaatctgcagacacacagacaggtcggtgtgatttctcaagtatttagcatttagacgaacagatttctaatgcagtgactaactaattcaaaaaaaacaatgctctgaaatgcttggtggcacttgatgtgaagtaaatcaaataataagcagaatttgaattagaatagagggagagagacctgcgcaagaacatgtttgggcaaaccggagccctggaagaaggagacggcttcggcaccgctgatacggccgtctcgatccaaatctgcacggcgaaaataggcatcgaagagatcgacattaggcgctgccgatgccattgcagaattcaacagcaccgcctgatttcaatagattccacacttttttagttctcctttgccttttcagatcacaccatgtatttaattgtgattcataaaagctcaacaaacatcaaatttcgtaccccaaagattgattaaccgcttgatttgcactttgcttgcctccaatcgaatccgatcaacacactcacccaccaacaaaattacagatcatccctcgattctcatttttcgcccaacggacaattttaatgctctttactgtctgaatttcaaaaataccacccctcgtcacatttttggggagaccctcgccaactgcgactatttctaagtttttttttttatgtaattaaagtttatatttataataatacataaaaaaatataaattatattttaatttttattcatgattttaggtcattttttattatcaaaaataagtattttattttgtattggatcatcctgtttgacttatcctagaaaccaatttgctcacttaagtatttatggtcgctcaatacttggaaaattttggatcatcttaactaactcgttattgagtttatcttaatcacggacttgtgtcctaggtcatgagagaaaaaaataacattatcataatcactttatttctcaaccaatttagatactccaaaaagttagtcttgtatttatattagatacttaaattgttgaaacatgatgacataatcacgaaagtgtatgtcttgatatgtaagacatacacaactacatctggtacatggggggacaagaccgagcccatgccagagagtgaggatgaaagatttgtgagagtctcctacgagtcgtccgacggaaaagactttatgaatggagtaaaagaacttgggatcgtcgatcttttccttaaagattgggatgagtcgatgtcgatcgatggtgtgaaaacctcaaatccaaatatatccttttttggatattgtaagtcactcttcattctagaaatcaattttcaaaaacactcttcatgatacccttttcaaagcaccctgctatcatccaaaaagtttttgttagcaaatgtcatttagtcacttttgatatgtatcttcaattatagctatattaggattttgaatgtggaggatagtggaacgaaacatggtgaattggaaaacaattacaattgaaaatggagtttattagtaaaaatgagaaggtgtgaatatcatttctcttgttatattttcttagactatcggggtcgaaaacctttagcatgttttcttcatttatttctcggccttttctttttaggtcattttttcccccaacacagcccccttttttcaattttcaaaatatcaaaattatccttccctttttttgaaataaaaaatcacgcctcttctctcatctcacataccttgtcaattaaaaatgaaaaaaaaaattataaataacctaacaattttgaatttcgtaatatctcaaaatttataaaatgctcttttctaaatagttgataaatctaaaaatgaattttgattttaatgcatacgaaaattcataaaatttattttaaatttcaatcattgacaaaaatatcagaacatataaatgtaaaaaacttaaatcagaacataaaggatagagaaaaatattttttatttgttaaattattcaattttaaattactacaatacacttaaaattaattagttagaataactaaaagagtgattttttgtcctaatttttgttgtagcatgttaatacacaccaactcaaaattacaataaatagagtttttttttaagaggctacaatagatagagttaaaacctttttttttaatgaagatagagtttaaactcaataactataaacagcataaaaatcaaatatgctttttttttaagaaaaaaaatcaaatatttaatacaatattcacaatagacaatgaacccctcaattttacacacacacatatatatatatatatatatcattaaatatttataaaaatctaatttttttacatacttggttttttccctataaactcaagcatattattaataatcgactgcgaaatataatgacgaacataatagataaactttagattagtgcatgacgtagatgctcatgcaagaacataagtcaatacattagcatgtcttttcacaaacttgactctaaagtttgaaaataatgaacggatttgtctaccctcatctaggttgtctccaaattcagaaaaatcaagatgtaagttatgagagagattgtttaaatttaaaaaaaattaaaataaataattttaaaaaatgtaagtttttaataaataaatatgatttgtttcttaaatatttataaaaagtacttttgtctaattagacacagttatttattttaataattttttaaaatattttatttgtcacattagacaaaagttaaggtgtttttttatgaagagcaactaaaactaagttttatataaaatatagagattaaattgaatgatataaaactttgaagaaaaaaaaattcataaaaagtataaagactatttttttattttaaaaaagttcttaatttgtttcccttaaatcattcatcccattcacacagaacttaataaacttttctttagtatagagacatctaaattctataattattacttaaagatagttttatcgacttttttagcccaaaattgtagagcaattgttctttgggaaagaaaacatgtgcagtggaatttaattgagttattgggttgagttggatttttttagtgcaccaaattagattgggttaggtaatggatttataagttttaaattccatcaaatccaaccaaccagactatataaataaatatataataaaaattagtaattatctaatttttttatatgtattgtatgtaagagattatgagtaataaaaagtaaaaagattccaaatcatcactcttgttcactcgcaggccatgatagtttattttgattttggagattgactcaaactaataattgagttgtaaaacaattttagaatactaattgtgaattataaaataatgaagtaatgaatattaattgttatattataatgattaattaagaagcaatgaaaaaatattaggtccggttgaggatggttgtgagtttgccattttcgattttaaaatataatttgaaaactgaaacgtgtttggataaaatggttgccagttgaattttttcttcttttcaaaacagatttcaaattatttcaaaaaataacaaaattaggtttgtggattttagttattgatttatcctaacccctcttccccctcaagtgctctatttctccctctgttgttcatctctcttccgcacagaccaacaaaatctccctctcctccacacagagaccagcaacaccaccactgaactcgcctctgccacctccccaatcctcagcttcaccaccagaacacgcgtagcgccccctgcatccactgtatccccatcttcaccaccattccccaatcctttatccccgcgtcgactcggaaaatccttcatggaacgtacgagcttctgcgcagccttcccgagttcccgtcacaacgaaaatccttcgagtaatttacactccattgtacagaaattacatttaaaatacaaaagtgtgggggaaaattaagcgaactgggtttaaaaaaagactggataaaaagtatttttttttttaaagcctttcaaatttaggcacgaattttttggcttccaacctgagcttaattaatttacattattaatttaataattaagacaaaataaggaaaacatgaaagaatttttttattcgcaacttgtacggaggatttgataataccgagcagttatatttctacataaacttcataataaaaaaactcatacaataaataaatacagtagataagaagaaaagagagagaaaatgacattaattttaagtcttgaccaaaatcaaattgtttaaagaggtcaataacaattataataacacagctttccctaggatgcaaattagtaattagttattctattcctatgctacttttgattcaagtgtaggcattctacttaagtaatcgaattcaggtgtgagctgtcgaaaactcgtctattaattatattcaacggcatcataactctggtagaaattcgtaagagtgtgagactatttcagacggggagaagggatatgggtttctgtgacacagttttatggttgatgtaaactaaacgcgggagattgggttaatttattagaattatgaaaatgactttggtctgatttgactaaatcctctctccccacgccaaaccaagctacgaaagttgactaggataacaagtgtaggctggcagcaattacctgcgaaggagtgagcctctttcccacgttgaactcactgaccctgacccacttcaggggtggatctagaaaataaattaaggggggcactttaaccttgcaaaaaataattttatgttcatagatttagtggcggggagttgcccccaaaattttttttaaaaaaaatttaaatcaatattttatgtacaaggttatgaacccgcttaaaattatattatatatatgtatataactaaaattatttgattaagaaaattcatccataattctatattgaaaaatccaaaataacaattgaatttgataatacaagtaaaatatattaataataaaaaagactgtaaatagcaactacctaaattaaaactcaaaagcttatttcaaaaatgtaatatgaaactgcagaaaaaaaagtgggtacagaaagcaaattagacccaaataagacaaagctagcttctcctattcttcttcttagttggtgtctgcggcactttctttctagtttccatttctgttcttataagttgatttctctttctcttcaacgaaaatttaaggggagacactgcccaatttcaccgctgtttcaccattccaacaggggtattataacttgatcccaaaaatttaagggggccacatgtgacttaatatgtcaatacaacaacaattaataaatcatccttccattaaagttttgccttttactgtaccatacacatttcctataggctcttcaaagctaaattcaattattgaaggcaaagaaaaagagagaagaccaaaggcaggtgtggaaggaagaagaaagctttcatcgaccggtgttcaactttaaacactgaggaagagccacaaaattattctttctgcagggtgcaaggtacagcttcaatgggaaattgctggggttctccacctcacaacccaaccccaataactaccggtaaccttagtacaggttggttgggttgttttgttctttggtctcaattcatttgatttctcatgtgttcatttaatttatgatttcccatgtgcaggtacgacggggacatctcaggcgatcagcagcggcagctatactactactacgactactacttcttctggaagtgggagcagctccataaatagcaagttctcagtgtcaagcggtggtcagccttatccaaatggacagatcttacctacctccaatttgaggatcttcacttttgccgagttgaaggctgcgactagaaatttcagagctgatacagtgcttggggagggaggttttggaaaagtctacaagggttggcttgaagaaaaggccacgtcaaagggtggaagcggaacagtaattgccgtaaaaaaactcaactctgaaagcttacaaggacttgaagagtggcaggtaatccttcataataatcaaaccgcttttactttatttacttctacatatccttttgttacttaatgtactccgctagctatgagcagcccctgtccccagaagaagatattttatgcacaaaaactttttggtagtatcacccttctccagcccagtttcaagcaataatttggaacaagaattagaattttgaaactcaaataataaccgtcgtcgtacccatgcaatttcccttcccttttagttttaggatgaaggcaaagcgtagcagaatgagcatactgcttcttacttggatggcattgactgctttactaaacagaattctaagatctcaaatctggaaatatccccatgtcaccgtgtgggtagcattattcacagaaaaaagcagttgaattgctgaatttagggagtttctgaatagtgtagctggagagtttcatcatgtgtaaattgtgtaatatattatggtattgtaataaaatgaaggcattggtttgtgtccccagccccctcctttcgttttgttacttgtttcatcaaactgttttgtcgtacacttataaattgctattaaactaatggttcattcatttggtgcagtccgaagtaagttttctaggacgtctttctcatcctaatcttgttaagctgttgggatactgtttggaggaatcagagcttcttctggtctatgaattcatgcaaaagggcagtttggaaaaccatctatttggaagtgagtgcttaatgccactgtcttggcaagtgtattataagttcaaacatgaattgaaatagcaaattaaatgtatattttcaactaaaagctacattattttaattgtagggggttctgctgttcaaccacttccttgggatataaggcttaagatagcaattggagcagctcgtggcctcgcattcttgcatacatccgagaaagtaatttacagagacttcaaggcctccaatatattgcttgatggggtgagttctgcacaaaataagcatacacaatatatatttgctgttgccatgctatgagcatgatgaaacaaattaatgttttacttattttctatcttcaacatcagaaatcgttttagtttagtgtgtactattgggtggtcaacttaattaatttctgttatgctacagtcctataacgcaaagatatcagattttggcttggcaaaactgggtccttcagctagtcaaacccatgtgacaacaagggtgatgggcacgtacggctatgcagctcctgaatatgtggccacaggtaatgtcacgctgttctaattgtggtgcatgtgcatatttggtaaaactgatttttttcttgtgttttcaaaactctgtcagtaatttttgaattataagctgttagatacaaaataacccaattgaaacgtgaatttaaagcaagtgatgttattttgtccagctgttttgtcatgttcaagtttttttgtgggggtgctggaaatttaaattgattattagtgtaccttgaaattttgtgtagggcatctttatgtaaagagtgatgtatacgggtttggagttgttttggtggaaatactaacaggcctacgagcacttgataccaatcgtccaagtgggcaacaaaatctaacagagtgggtgaaaccctacctgcttgacagaagaaaattgaagggcattatggattctcgattggaaggaaaatttccatccaaagctgcattccgtatagctcagctttctttgaaatgtcttgcatctgagcccagacatcggccatcaatgaaggacgttttggagaatttggagcgaattcaagctgccaatgagaaacctgtggagcctaaattccgttctactcatgccggacgtcaaggtcaccaggctgtgcaccatcgttctccacgtcaggacggtagtaattagtttctcttaagaaaactaatccctttggttgcttgtgttatttgtctctccgtttaagagtttgcctgttgttcattatgtatttcttggactcacagatttgtacgggtaagtcatgcattactgtattagtattgtaaagtgtaaattattgtgtgttctgctaaacaaatggagaggtctctagtacaacattatcagggaagtgtttgcattaaattcaacgagtctatctagagacaatgtaattgtttacgtatatatggactggtgaaagagagaagagtccagaaacaatgattaattacaaagcagcttcggttttgtacaactaacttcgtaacatattcaagattatagtgtaacggacattttcttctgtgcgcctgttagtttatatcttatctggcattttcttcttgcactccccattttaaattgtgtggacaaaattgcccttaatcccacaagtctcaaccctaaatctacacaaccgacccctccactgtcgcctccgcctcgatagcacgatttctgacgccgatgccgttcctagtgctaacactatcgcaccactgtgactcacccaacaaccaacacaagaaactagcaccgacgagaaagtccgttgtggcgaccatccccatgaagaagcccttcttcttcaataatgtcgatttgcttctacggcttgaggctatggttgtggtccttcttggagaagctcacagaaaaggtgtggcgcaagtgcggcggagaagcaatggggatgagaacagacgtggagtgaaacgatgtcgttgggttttctcttgggagtttgcgaggtagtgatgaaggagaggctgggggtggtgcagcgcagatgaaaggtctattagggtaaaaaggaacaaggatattgccctatttcagaataactattcttaaatataaaaaatacattcaaaaatagatatttcaaaataagttttggagtacttattcatattttggaatgtagtttttttattatttaagattaaaattattctttatgtaagataattttatttgagttgcacacaattattattaaattaaaataattttatgtctattaattttcacacttaatgataataatatatcatatatgataagtctcttaatttattataactatcttaaaaattatactaataataatttttaattagttgatggtgtaaaatttctatagtataaatacatataaattaaattctatcattagagtattgttagagatttttaagagtttaaattttatatattttcagagtaaaaatttgtgcaatcaattaattagaaattattatttcactattaacatagttataataaaataattatattttttggtaaataaataattattttataaagtgatttgtaattaaatgataatataaaaataataaacaatgtatttactcatttttttagttagatgaacgattacataggaattttaagaaaattaaatcaggcttagtaggatttattcaataaaataatagagattaattactcaataaaagtttaacaaatgtatcaaaatatttatcatatatttcaattaagtgggtcccaaaaaaatatgagaaatatatatatatatatatatattataaaataaactttcaatctaaggtataaactttaattgggagtatttatatttaatgcttcataagatcatgtcatgtcatgaaaataagaaatcaagaataatattaatgtacaaatttggacatagaaagatgaataagactaagagaagagaaaaaaataaagagaaatatgtgaatgtgataggaatgagaatgagaaataagaaagaaaaaaagaggaaaaataagttataacatagtaagtaagatgtaattatctcaaaattaattgttttaagagaaaatactaaacaattagcttagtcgttaaaaatggaaatggaaaaatatccgtgggaaaatgttaaattcaggaattaatgtgactgaatttagaaattcaggaaccaatgacgtaagagaaaaatatccgtgggaaatgaaaaaaagtaaaaaaaggttgaataactggccttgtaggttccgtctaaagaggaagacgcaagcatagagttgagttgagttgagttgaggaatgaagtagcgtagcagtgtcatcattcatcatctgatcggcgttgctatggatatcatcttctccgttgcttttctattacaggcaagaactgattcctctcctttctctttctctttctcttaattccctgttgatcggttggttgacttggactatcacactcatttccactgtccatgttgatgtaggtattcctactctcttcttcgcctgctacctcacaacatgaaacctataggtacgtacggctaaatctacattcagattctttttttccgaaccactaataatttctctttagggctaagcattctgaagaatactgcgcaatgtatgatatatgcggtcaaagcagtgataacaaggctctcaattgcccatatggttccccttctgtcaaggtaattcattcatctcttttttactaaactaattaatgccgcaccatcttcatttaactataatcttctaactccagccatcagacctactgtctgccaaaattcaaagtttgtgccccaccataactggaaatgtttgttgcactgcggatcagtttgacacactaagagtccaggttcaacaggcaagttttttaactcggtgattttggttgttgtctgttgcattagctcgctcttaaccatttctagcttatgataaattgctttatctttttcttggccgggggtatcccaaaaacttatctaatatgcaggactagtatagaggagatgagggagaatatatacagtttatgttggactggctattttatgaattttcttttactactctcattaatcacctcattgacatgatgacatattgacctagacccttatcagtattttgtttatttctgtttttattatgcagtaacagaaactttgtatcttgcaggctgtaccaattctagtgggctgtccagcatgcttgaggaattttctgaatcttttttgtgaactttcttgctctcctaatcagagtttattcatcaacgtgacttctatttctgaggtcaggcatttccttctctgaacttgttttttagtaacacttttttttttttttttttttttttttttttactttttaagtttttgggtggctcatttatggttacaggagtgttttctgtgcttctaggtttatatatatatatatatatctttttaaagtaactgtacaactttggcatttgttttcttttagctgcatgttaccctatttgttagtttttatggtttggagatgctgtttttggagttccaggaagtctataatactgaacgatttggggagtaaaatttccagttattcaccagaccagtgttccctttaccccttgtttggttaccatggaaaagagaagaaaggaagagaattgtgtggaaatgtagggtgcatgtgtgtttggttgtctggaaatttttgaatttcagtatgggttccatgccttttatttcttacctaccaaacaacttcaattcaaatatttcctctctattccattgcattccattccctccctttctttcctctcaaccaaacacaccattaatgcaattattttatgtatctgtagcttcattgcaaattatgtagtggttgcttccgagtttataataaagagaaataaagtgaaaataatatatagtctctagagccgataaaaaaaaaaaatctgtaggtaggcttgtatcctcattgcaagcttattcttttcttatgacagtaggttcctctccactggtggatgtttaaaatgaaaaaatacaacaataaagtagctaaataatggtatctattgatgaaatcataaatgaaaactttagttattaggttaaatgctaattgctaattcaggtgtgaaatatgatgattttagtgaacttgcaatattgtttagcttggtattggcaaactgcatatgtttagctatagtttcttaatcatgcctcattgctcctataactaaccaatctttcctcattaaaagagtttagaagaatgtaatgatttgatgctttttgtgtttttatttgttaatgttacatgtttatgataaaaacctttggagaaccacaccacaaaagctaactgttgaagttggagagcccaaagccttataaacccccccctagaatcccatacttccaatgtgagactcaagtcctatatcttgcaattggatcctaacattctaccatgctccgcaacctcaatgcccatgcgggatgttttgcacccataatcatgttagtgttttatgtagacttattgggaaaaatgaaacttagttcaaatatttataaataactagtatgttgagttgtgcactagcacggttgccttgttccttatatatgtaccaaaatggatgacttgtaactatagtaataattttccattgtgctgctggtgtcattttccttcttttttattaagcccaagtagctttcttgttgatataaggtccagttttttttgttatattttatctttagtaggcaacaattggtttgggcacatataaagaagaccactagaagtaccagtgatgagattagattgcatggtttttagcatgtgaaaagggggagaggggagacttagaagaacattggaggaagttgttaagaggaagggatctcaaaagagtgatgagagagagagcgagagagtttagagagagagagcgagagtgcagagaaagcgagagagcgtttagacagggtaacagtagggggggtagaagaggaaacccagacagccaccattacggtgagcttaggtacggagaacttcctgcagcaacggcgacgaaaagaagcacgacggcaagaccaaacaattggagggaacatacagatatctcatctttctattttacgcgctttcctgaggatctgggggagaaggatttgtggttcatcttcaaaaaatggggggatgtgagggaagttttcatcgcaaaaaacaggaataaaagtggcagacgttatggcttcgtgcggttcaaaggtgttgagaatattttgcacctggagagaactctggacaacctcatcatcgggggccttaagctacacgcgaacatccccaaacatgaaagggaggaccgtattagagcaatgaaaggcaagaatgttatgtttgaagaaggcgtaccaggtgcccacgcagggagagatattcatgggccaactcacaatcctcaccttccaaggcaacctgtccagcgggcaacatatgcacaagtggttgccaaacctaaatatgctggtaggaaaaaatggtatccgaagcgccgttacgactttaacaaaccatcctcctcgacgattacgcttgagattcaaatggaaagtaaaaaatggcttaatgaagcatgggttggaaggctgaagaaactgaatatgttcgataggttggaggaggaaataggatgggaaggagaaggggatatcagaccaaggtatattggggaagatatggtacttctgatgggcctaaatgatgctaaagtggaagagatacgccgacacgaagaagtatatggaatggaaagtttccattctctggaaaagtggaatccaaatttgaaacccgccttccgtcttgtatgggtactctgttggggtatacctttacatgcatgggacacgacaactatggccaagctagtgactgcttttggtgaactggtggaagtggatgacgaaactgaggatctccaacgccttgacagagcgcgcttactcatcaagacaccatggaaaccatttattaggcataatattatggctaccataaacggagtcgatttctcgattaacttcgttgaagaatcaaacgcggggacagatacttgccgatgctcaagacggtgtggtgcggacttctccgacgaagttacatccatggacagttctgaggcgggtagtgacttggtcgagttccagtcacatgggtatgtttcaaacaccccgcagcctgcgcctcaaccgcgagaggtcaccccgaccacctcgccgccgacggtggtagcaaccgaggaactcctgggtaacccagacgaggagcggtctgtacactcaaggttgggacagaaccaagcggacagtgctttcggctctgacaactgcaacaacagcaaaaacgctgtcttggtcacatcaactgacaagctgtcacctacccactgtgcacacagtgtggaaaagggaggggagaaggagggatgtcctgaatcagactcgcttttgcggaagccagaagaagttgttgctacaaagaggaaggtcaatacgggaaagctgtcgggagcagcaaatgctggatcagacagccttatgtcagggcaagagagagacccagctatggggaatacatcagataggatggggttggaatcacgtgaggagacaatagtgagagattctctagaggctgaagggggccccactatgggagaaaggatattatcagaagaaaataaaaacaactctttgggccaaaaaagtaatgggcctgaatggcaagtatattccagatgcaggggaggtaaaaacaaggctgttctagttaaaaaccaagctcacgacctggacgctaataataaaaaaaaaaaaaaaaagaagaaagttcatctgtgaaagagatggaagctaccaatggacaacaaagcccacttacacccataaaaagccacaaggagagtggtttaaaagggattactgaatgggggggaggatcaaaagaatttgtcactataggatccagctccagctcgacatctataaattcttcaaaacaagttgacttctgggcactagcccaacaatttggggtcaccagccacaacccggaagagttgattcacaagatgaagtcattggaagaaggaatcaatggtgaggcattgaagtggggtttctctgatggggatttatgaagatcttatcatacaacataagggggctggggaggggggtgaagtggaattcaataagaaaaatggtgagcaaacacaatgtggatctgttatgtctacaggaaaccaagaaggagcttattgataaggtgttatgccaagctttatggggagattcaggtgcaacctgggaatcacaatctgcaatcaacaaagcgggaggtttactttgtatttggaatgaggagtcttttaaagtagaaaaaaggctgaaaggcagcggattcatttatctggaaggactatgggtacctgataacaaaaagatcacaattgtcaatatatattcaccttgtgatactttgctgaaaagatccttttgggatgagattaagctgctgaggatgacaaatatgggcggcttatggtgcatcattggtgatttcaataacattcgaagagattcagaaagagtgggagtggcacagagcaaccaggaaggtagaattgttaaggaattcaatgattggattaaggagcttgaagtggaggaagctcccaggattggaagaaaatttacatggtacagaccgaacggaacagcaaaaagcagattggacagggctttggtatccgctgaatggctaacattatggcaggggtgttcacagactactttggaccgcaattactcagatcattgcccaattatgctcacatgttctcatatcgattggggccccaaaccttttcgttttcttgactgctggttacaggacaaatcccttaaaaaggttgttacagaatcttggaattctttagctggaccaggctggggaggctttatactcaaagagaagttaaaactgcttaaacagaatctgaagctgtggaataaacatcagttcggagatattcaacaaaaaatcagaagtgtagaactggaactgaataagcttgagctagaaacagaagacagacaaatgacagcggaggaaattaaaaggcgaaaacaactacaggaagatttgtggatggcagcaaattctaatgcttcgttattgaggcaaaaggcaagatcgagatggatcaaggaaggggactgcaactcccgtttctaccacctgtctgttaattggaagcgacggaaaaacttgctaaatggtgtgtcagttaatggggtttgggtagatgagcctggtagagttaaggaggaggtaaaaaaattcttcaagcataagtatcaagaacctgacttcaatagacccaaattagatgggattcaatttaaatccctggatcagcagcacaatatttctttgacagctccttttgagctgtctgaaattaaagatgctgtatggagttgcggtagtgacaagagcccgggaccggatggattcaatttcaaattcataaaggaattttgggacacactaaagcccgacgtgttccgcttcatggatgaatttcatgccaatgggatttttccaaagggagcaaatgcctcatttatagctttgatccctaagattttggatcctcaaagtttaaatgaatatcggcctatttctttaataggctgcatttacaagattgttgccaaggtacttgctaacagactcaagagggtgatgcctgccattattgacgaacgacaatctggttttattgaaggccggcagctattgcatagtgttgtaattgctaatgaggttgttgaggaggcaaagaggaataataaaagctgcttaatcttcaaggtagactttgaaaaagcgtatgattcggttagttgggatttcctcatgtatatgatgaaaaggatgggtttttgttctaaatggatgtcatggattaaaggctgtttaatttcaacttccatttctatcctcataaatggaagcccgacttcagaatttcagcctcagagaggtctgagacaaggggatcctcttgcccctttcttattcaacattgcagcggaaggcctcactggaatgttgagagaagcccaagcaaagaacttatatgagggttttaaggtgggaaggaatcatgttgatattagcatccttcaatatgcagatgacaccattctctttggggcagccaccaaacaaaatgtgctagctttaaaagtgttgttgctgagtttcgagatcgtgtcgggcttgaagttaaattgcaacaaatgcagtgttggggctttgggcatgaatgaacattgggtttctgctgctgctagtctcctacagtgtgggatgttgtccgtacctttcaactatctgggcattcctataggagcgaatccgaggagggtttcgacatgggagcctatcattataaagtgtgcgagaaaactgtctctatggaaacaaaaatacctatccttcgggggaagggtaaccttaattaaagctgttcttaactcgatccctatattcttcttttcttttttcagggtgccgaaacaaatttctgcgagcttggaaaggctgcagaggaggtttttgtggggtggcagccaggaacagaagaaaatctcgtgggtgagctgggaatctgcatgtctatctaaggaaaaaggagggctgggaattaagaaattagatagttttaatttggctttgctgggaagatggagatgggacctattccatcaatcgggggctttgtgggtaaacatcttggagtcaaaatatggaggttggaggagtcttgacctcacaaggagaacgtcaacagaatctctgtggtggagagacctcagatcgtcattctcatctttggaggcagatggatggttctccaaaggtgttaggtggaaggttggttgtggagataaagtactgttctgggaagacagatggatggaggacaatttatctctaaaagaaaaatatcccaggatatatcagatctctctacaacaaggtcagcctatacagcttatggggtcacccaatcagggaggttgggagtggcactttctatggagaagatctttcatggaaggtgaattaaatacggcgataaaatttctggaggaaatacaaccactgtcagctgctggacagcaactagattcatgggtatgggcgagagatcctagcggaatttactcagtgaagagtgcctacagcttgcttaatttggaggaggccaatcaagacagagatgaagttttcaacatcctgtggaaattgaaaatcccttgcaagatatcgtgctttgtttggagactcatgaaggatagattacctacaaaacaaaatctcagaagaagaaacattgacattgctgataccacatgccctttctgtcgcagctttccagaagatgcttcacacctcttctttagctgccctaaaattctacctttgtggtgggaatctagggtatgggcaaacatcgtaggagtgtattcggatacaccaaaagaacatttcagacagctttctttctgccacctacgtgggaacaatcttaataggtggctctcttggtggtctgcactgacttggcgaatttggttccataggaaccggatcctttttcataacgaactctttaatggttatcaacttatggaagatgctatatttttttggtggtcctggcttaggaacctagagccaggttttgacataccttttcatcaatggtctagtaacttgagggaatgttttgtatcttaggggtaaacttagtcgttttctgttttatccttgttatcgggcagacctacgatggcttctgttttaagccttcttagttctgctttgattccttttgtatacttgtatagcagtacatcttgtactgttttgtttcttaatataatatattatatttttgctgataaaaaaaaaaaaaaaaagaggaagggatctcatggtgaataatatccatgaagatatggtcttttatcaagctgaatagtcttgtgtgatccatgtggatgacctcacctaatgggctaagatttttgtgtttatttttatcagtaactaaattggtgaatatagggggaaaaatcaaaacaaattgcattattaataggcaacatcacgttggcccacccaaataatttttgtgaaagaggacaacttacctagcgctacctcccgaagcaaacaaagcaaatgaatgaggtggtttggaaagaaaatcagtgattccaaatcaagcagtagtaatttccgttagaaacccaacaagaactcaatcgttgaatcaactgtacaaaaatatatcaatggttagaataagagatgaaaaataggcaggtaatgttttaaggagcatatgacattatgacgtattatattataggaaatactttgttttagcatgtctctcatgcatcaagccacttttgttctgttttgtttctgctagcttgtacttacagcagtacttcttgtactgtgttgttttcttttcatctatctatatataattatctttgctgataaaaaaaaaatattataggaaatactttgttttattatatagatagaaaaatcagtttttttcatgtgatttagtcttataaattcactctagacttgaaattataatttgatattgaccatattatgttcatttcaggttaatggtaatatgactgtggatggcattgattattacataactgaaacttttggagaaggtctatatgaatcatgtaaggatgtaaagtttgggacaatgaatacaagggccatagattttgttggggctggagctagcaattttaaaggtgattcattataacatgggtggatttattgtatgaaatatatgaactctgttattaagtgatcttaccttttcaattagaacgattcccccttcgtgtattgagtattgatatgttcattgtgcatgttttcctataatttgggatggatcttgagttttgcacaacaataaatgggaaaatggggagttaatttaatgttagcttactccttgtatgtcattttttttttttgatcggcgctccttgtatgtcatgtttgtagttctgaggtagaccgcagatatacatgtttagccataaaaaaatacaaaagatcctcctaagttgctgcagacataccttttcttgttcctattttggtactaagtagctgctaatgtttttcataccattagaatatttctttttctctttatctgcatgtattatacttgctcttcatctgctaatgtgttttgtttttgattgtcattgccagagtggtttgcatttcttggtcagaaagttcctcctggttttcctggttctccgtattctatactttttaagacaaccattcttgactcttctcctatgaaacttatgaatgcatctgtatattcatgtaatgacacttcgctgggctgctcttgtggtgattgtccttcatcacctgtttgctcgggttcagaaccttctccatcaagaaaagatccctgctccattagaattggatctctaaaggttgaaacaatagaggctggttttttctttataattaattttcatttgctttatgactgaataaattctctgttttttctttcttaaaagtaatgccttatgaatcataatctagtggaacaattggttccctactgaaaaactgtctttcagcttttgatacatgtgaaactggttttcgtataatgatacctacaggtcagatgtgtagatttttcaatggccatcttgtacattgtattggttttcgtgttgtttggatgggcattgctgcaaaggacaagaggaaggaggagacttggatccggtgcggaacccttattggatgatatggttggtgaagggagtagttttgctaacctccaaaaggatggaactcatcctgcagaggtatgtttaaaagcttgttttgtattgacccatcgttttggcattcagaaggaagatttcatttcttcttgttattattataattgtggaaaccagctgtcccaaaagctaattgttaggtgaagtcaaatgactgattttataattaaataatctgtgcatatcaattcatgcaagagctctttgggcttgaaacatagataatgttcaggttcgcttgtcttgtgcttaatttcaacttatttatttaaaagaatgggagctgcaagggcgatctctagactacttggtcatatagactttaatactatgtaatgaaccaactatctcatagagatcaaatgttaatcaattaacactaagtataggtcttagaatgtgggttgggcctaactctaccccaaaagctagctcatggggtgagggttgccccccacttatatattctatctttgccttatctctagccattgtgggacttgggtttttcccaataataaggaacctttatttattctcttaaataaatgatattccaaatcaccaaatacataagaccctttccgttagcatttatattatgtgtagtttattttttataataaatagtcatcttttcatacattgtgaagcagctttgcagattgaagtcttttgtattctctgtttgaagaaagtttttaatccctcctcaaggttttggatgtgcaaagcagaataaattgcttaggaaatgtgttcttttgcctggtgtatgctgcttttagttggagtgaaataccttaattttacttgatgttttctttcttcatttttttttctcctgttacatgctccttttctttttataacattttttcaggtttcacctcaccagtcttttgaaggagtttctttgtattattatgcaaagggactgctaacacttctatgctattttttttttatcaatcactccccttgctatagggtgatatctgattctccatctctgtacaacttttctctcatacaacttttctctcataatgaactcttttgagcccctccccccaaaaaacaaaagaaaacattgttttccaaaatccattcctgcttaaacttgaagataatttgaggagagtctgtttttgataactggaattgtatgcatagtagtggttgttgaaccatattttgtattacagtatttttactgcacaggactgctacccttgaatacactgtctaaatttcttagaatctaacataagtaaagtagggactagggagctattttctattgaataagaaattcatttaagatcttggagttctaggaaacactggttatacatggtatgtaaaatgatttggataatgcatctgtaatacaactttgttgtgttttcttctggtttagctgtgggacctgaattaactcctggaatcttgtttctcaatttgcctctttcaattctatattaagatgtgttagagttaaatgatttatttcacatgtataatgagcagttttatttattactcattatgatattgttggctttgtattgtcaaataaaaggtgcaacggatagatcctcaagggcagaatgtggtgcaattttcttttgttcaaggatgcctgtccagcttttacaggtcggtggctctagcagttcttgctaggtttacaattacataatctttgattttgtttatgcattcaggacatatggaaggtgggccgctagaaaacccacaattgttctttgttcctcattgacaattgttgttttgctttgtttgggtctgcttcgttttgaggtggagacccggcctgagaaggtaccatattttcatctatattatctccacagtgtacaatttggatttgcttctgtaacttctacatccattttttttatctccttcctggctatcaaataatatctaccttatcctttttatgctgttactttgttttttttaatctacccttagacatgtttggatgagctgttggaacatatgctcaaatgttaagcacattttgcataatagctcaagcaaattaaaattgttttacactgtgaacctatacttataaataatgtcaagaaaaatattttcataaaggcttatggtaccaaataagtgcttctaaacaaaaaaaaaaaatactgtccaagggttcattcttatagcaacaacctttttgtcttcttgagctttctggatagatacataccagtcaatttatgggccttaattcctgaattttagagaattctcaatattctaaatatatataatcatgatttttctgtggaatggtttttgtgtttgttttcttgttcttttacttgctggaggacatttattctctaaatgggtatcttgctctcgctgcctctttaataatatttcttctttaatcctccctctccaacacacaacaaaatgttttctagtacttcaactgcaataagttttaaaaggaacatatatatgctcgtaatccttattttcttcttgaagttgaagaatatcggccttgctgtcttctttgtgttgcagttatgggttggtcccgggagtaaggcagctgaagagaaagagttttttgatagccaccttgctccattctacagaattgaacaggtttcagtttgcttgtaatttattgtacttttctttctggtctcgtaattccatgtgtgtcatctacttactgaaatctaggctccctcttatgtaaatgagttatctagcatgcctgctcatttgcatgtttggcctttaccacctctcttccccacccccaccccccccccccccccccccaaacaaaataaataaataaaggaagaaatatattaagatggagagaacaaaattagagtttgaaaaataaggaatcctcaatgaaatgaagctacctaatccctgaacatatctacaagggagatctcccctcccttaaaaagaccatgtgatttatgccaaatagaagccaaatttctgactttttgatccaatgaaacctccttaaagatacgagagatacttgaatgtattttccacacagaaaaatgatctatttacattcaagagtattacaatgacgattaatgccaaagactatttacaagggagcaattaagataccactacttcctaagatacactgaggctgaggtcagaagccttggctgctacagctgacattttgtggattcagactcttcttggtgagcttgcagtccctcacctcactcctatggtgctgtgtgataattcaagtgctctgataaaataaaataaaaagtgctctgataccatcttgataaactgatattattgatatcaaaggagaaattacaattggtcaaagagtctctgtttacactgagatatgtataggcacagagatcctaactaactagtgacagttgctgacaatgtactaaccaactgacagctgtacacagctgtattgactaactaagtatgaatgagataaatatctcagcaaatctcaatagatatgttttgtttatttatcaaataagacattttgattttattattatgttgatattgatgctgatgcaattccaatttccaagaaagttttccgtttctatcgaaaacatgtactttgcggagaatatgaagtcaaccatagtttcctttttaatgtttttgttaagttgccttcttatttcctgctattattttatctgaaataaatcacattttaaaatattgtttgtgtatatttcagctcataatagcgacaatccctgaatctaagcatggcaaaccgccaagtatcataacagaagaaaatattgaattgcttttcgaaatacaggaaaaggtgttttgattttcagtttttttacttactagaatttaaatggagctgttgtatgcttagtggggccttctttattaaaaaatatgtttacatttcaatattccaacaggttgatggaattcgtgcaaattattctggtttgttagtatctctgagtgacatttgcttgaagcctttaggctacgaatgtgccactcaaagcattttgcaggtccaacccactaatttccaaattattcctgtagtacttttgaattgtgtattgcgaataattaattatttggcttctattatctgtaagttgtacaaccagttggcttttcttattcagttctatatcaatttactattctttttttttggcatacttagaagccgtcatttgatttccttttttgtctttattttattctaatagtattttcaaatggaccctgacaattatgacaactacggaggtgttgaacatgctgagtattgttttcaggtaaacttctgtgatctgattatggattaccttagttttgttattcaaacgagtttaatttaaaacagttttactttatgagcagacaaatattgtaaaacaaaaagattaatgtgttaagaaacactaaattccaataagcatactaattcaagttgaaatatttgcataggtatggaaggaatacctgcttttcatttcttttttctttataaatagtgtagctgtagtgtgtcaaatgcattgaatgtagaaagctccgttggtgcttctatacataattacttcttatagattatggtgaatttatctcatagcttgtgtttaataagacttaaatcttattattttattttatcattttcagcattacacttctactgaaacatgctttagtgcatttaaggctccccttgagccaactactgccttgggagggttttctggaaacaattattctgaggtaagaatcttgaattttagcatagatttctttttatgtgttactgctatgctgattcacctattctaggcttctgcatttgttatcacgtaccctgtcaataatgcaattacaaaagttggagatgagaatgggaaggcaatagcttgggaaaaagcattcatccagttagctaaggtatgactactaaatatatttattgcagttattaattcttgtgtagcttatatgcacaaaatcttcattttcattttatttttgacatctctccataaatccttatgttgctgttgttttcttgattattgaaagaaaattggttgtcatctttggtggtatattaaacttagtaattaactgaagaaaccaaggggacattttgttgaggagcattttggcaacttattgtctgataaggatcaaataaccactagattggttattcagtttgacataaacaacccaacgtaagtgtaacaattttgattggttaactattccctacaaacaaggcaccaaactagtgtgactctcccaagaaacaaccttaggatgacctagatgttggagttttgtgtaccaggtctaatctaagcagaagaaatgtggaagtcacggacatgatgtgccctttttgtagaaattacgcggaagatgcctctcatttattcttcagctgtgataaaattatgccgttgtggtgggaatcaagatcttgggtaaacctaattggggctttttctgttgtcccaaaggagcacttccaccaacactctttctgtcaatttaagtcacagaggtggcagatttggtgggttgctttgatttggtgtatctggtatcataggaacaggattatctaccataatgaagtgtttaatggtctaaagctgatggaagactccatttttttttgctagtcgtggctcaaaaatttagagcctggttttgccattcctttttatcattggtctagcaatttgagggactgttttgatgctcaggggagggtcatatctgtataattctaaatttctgttttttggggaggttttgttcctagcagttggtcagaacgctggtgtcttagccaatgctttaagccacctttgttctgagttgcttctgtttaggttgtaatcacattagtactacttgtactgctattatatattttcaataatattattatctttgctgataaaaaaaaaatctaatctgatcaatcaaaagctgaaagatgcctgagagtaagtaattttttttaagaaatagaaataactaaatatattttctgaagaaaagtccctcatcctatgatgaatatctctcgtcccagaaaaaagacctcatttgcctcttcattctttccagagagtaatgccattctctctttttcttacaaaaaatattaacttcattatctcttcctttcatctgtactatcccatcaccacactgctatttcttcttcttcttttggggtcttttcttccctgggtaaaaagcaccttgctttttagggagttagtctttgatagtgttagaagagcaaagggcaagagatactctcacactaatacaactaactcctacttaagttagagcacagatgttattcatacccagcttgttaaatatatttagaaaagccttagtattggcagatatgaaatactggacgagttgtattttgaaatgctacctgattgtttcactctaagaaatttgggcaagatgataaaccaagtgagattttccatttttcacgactataatttaccaaaaaatgaggtaaaaatacctgaccaaactatcttccctgaatgattgcaatgccaagttttttccatgttcttgtaggttgcttctgaagttgaactgttaaagtaaattgtcaatactttcctttgattccactcctgttgcacctcagaaaattctattcttatccatttgcaaacttttaaatgtcctcatcaaacttcccataattcctttctacatactgtaactcacatgcaacagataatctgaacaagcagcacataaaatttcttaccattttatttttcaagagacatatattaatttgggcctcaaactaagcacattagtctgttattggacatgagcacattctctttctaaagcccaagaaaatcactttcccattgacccatttatacatttaaagcacataaagtgtgtttgagtgatttgtttgcaaaattaattttgaatgaaattgattatgtaaaatttattttgaagtgaagtaatttatatatgaatgtttttactttaaaagcaagttagcagtaagcctcatgtataatttttttttttgtatcccatattagtttcctgatcacatggtccataaccctaccatagaatggaagccttatacaactgtaagaatctaagagaatttcagaaaactaaagtgaggtgaaattgttgattgtattcaacccaacagaaagatgattacacctcaatttatatagacagttaaacaactgtaactgttaacttattagactaagaaagttgcagatgaaaaactgtgtgttctcctgtggagaattctgcattaaatagtgctcatacaatttgatttctacatctgtgcattaaatagccaatctgcaataaatgctatcctacagctgggataactaattaaggaggtaattacagcagtataatgatgtaagatttgctgttttgaatggccaacaaatttgtgccaataataacagatattctgcaatttgtgccaattaataactaatattcttctaatcaattccattggcataactaacctgagttagttagtgattgctgtcaaacagctgtcctaacagataactaactaactatagactaactactaactgtagtttagcctttacagatcagtttaagcaaaaagaaaagtggaccgagtaagtatactccaatacttataatgttagatgttagattttgattgttagatgactctaggaaagaaaaacctgaggtctcggtgttagttaccctagcatgttctagtgaagtatgtttctgaatacagatttgtttatttgttactgatatgcatgcctctaaatctggctgtagcctgtaggcaatatattggtataaagtaaatgttgacccatccactgtcaacttttgaaataaggaaaagtgcacgagtgctttcagatacctacttataagtaggtttgagttaaattgattatattgtcctagtacaagtgtctatataatatgcttatttttttgagtgtgtgtacttttgcacgttgcatgatattacagatatgctagctgaatgctagaggtactttatactatctgtcttttcttctcattccttatccatacatattttgaaccaattttacatttggaaggacgaattgctgccaatggtgcaatctagcaatcttaccttgtcattttcaagtgaaagttcaattgaggaagaactaaagagagaaagcactgcagatgtcataacaatacttgtaagaaatttctgtttctttcaactgaatgtgaaaacatgatttgtgttgtgtgtaagctaatggactgattagtttggttgtggcttcataacgatgtgctttattggaatatacaataaatgtcttctccaacatattattaggtgagctatattgtaatgtttgcttatatatcggtgaccttgggagatagaccacctcatccatcttctttcttcctctcgtccaaggtacgttattttccttgaagctttcaattgtccttttcccatgatcccatctagtataccctgtgacactaaattgtttgtgtatattcaaaagtaaaaacttacatgcataatataagtgccaatacgtgctaaattgtacttcttaatgttaatgttcttaactaatgctcatggggattccaagcatctaaactacacagtagagttgaagtgtagaccattaattatgagatgagagaaaaaagaatgagaatagagaaacacattttattttctgaattttacttagcagagtgatctatttataataattgtgattaaaaagataataaataactgctattatcaagagaactacttcctaagataattcaactaagctaaatgcaataactaaactacatggaagaataattatcatttaatgctcctatttccaacattaataataataaatgcaaaggatcacagagttgacgaggaaacaatttgcatgttttgacatttgttatcattgtggtggggtgttagagatgtaatataaagagatgtaatataaaacagccacatgtcttcacctaataacttaagattttgggataattggttcatgacatggtatctgagcatctatgattgagtgatgtagaggttccttgctgccctacttcttctaataaaaagttaaatttcagctaaaggtaggtgagcctctgcatgtgtacactttaatccctaaaggttcttgcataagtaggcatgttagagatgtaatataaaattttcacgttttcatctaataaatttagcttttgcaatagttggtttatgacatggggagtttattttggaatttggatttactagttgatcattgtaaatattctcgtttgctatcatgttgtttgttcaagtatggagacttaggttcatcttaggttgccatttgtttttgacagagtccatagtattttctttaaattttgtgtttatgtagaatattatagagtattagaattagttgtggaatattctagagtattataattagttgtggaatattctagagtattagaataagtggtggaatattctagagtattagaactagttgtatataatgaaccctttgggtttcaatttgaatgaatgaaaaagagtattcacatttcaaaatggtatcaagagcaggttttcctgttatcattgtgcaactctgaagcctattttttttttttttaaaaaaaaggcctaccctcttttggtttgaggtgacttatggactcttctaataatacgagtgaggagtttcgtgcctctcctaattttgatggtgttttcatctccaaggctgggtatgagcaatttcagaaggtgatgcctcaatttgctgaagcaactagttgtgttgctcaacaaggtgttgctcaacaaggtacgacattccatgttaatggtagtaatcgttggattctcgattcagaggcttctaatcatatgacaggtaatgcaaccttgttttgttcttataccccttactattaactgccacgaataagaacagccgatgacagcttctctactattgctggatagggattcattaaactttctgaacacattactttgaactcagtccttcatgttccctctcttacttgtaacctcatctctatcagcaaacttacatctgattaaattgtgttgcgatgttctcggtccatgcttgtgtttttctggaacaggattcgggattgaaaattgacagtgctagagaggaagaagggctttactattttgaaaaggatcctaatgaaacaaatttttttgctcaccactcattatctttgtctgatgattgtaatgatgttttgttgtggcatcgtcggttaggacacccaaatttcttttatcttcagaagttgctcccaaacttatttatcaataaaaaatccagttctttttcttgttatatttgtcagtttgcaaagcatcctcgtgtttcttatcctcctagagttcgtcatgattcttctccatttaccttgattcatagtgatatatagggcccagcccatgagaaaaatatctctggtgctcattggtttattacttttattgatgatcattctagggtatgttgggtatatcttttaaaggataagtctgatgctgcatccacctttaaaaacttccatgctattcaaactcaattccagacctatatcaaaattcttcgaactgacaatggtactgaatattttaattctgttcttggatactatctcaaccaacatggtattctccatcaaagttcttgtcctaacacccctcaacaaaatgggatggttgaaagaaaaaatagacatcttcttgaagttgctcgagctcttttgtttaccatgcatatccctaaatatctatggggggaagctgtcttgcatgcatcatatctcatcaatcggatgccttctcgtgtcccaaattttcattcccctttatcttgtcttaccgacacctttcctttttttggggctcattctttccttcctctcaagttgtttggctgtgtggcttttgtacatgttcctcccattcaaaggtccaagctcgatcctaagtctattcgatgtgctcttcgaaaaggtaccagatcctgtactgctcaccctatttcttatcatatctcgtatgaaaagttatccccaggttttcgtgctttcaacactattttagacaatacaaaaataccaaaaaacatccaagaagcacttgatgacccaaaatggaggaatgcagtttttgaagaaatggatgcactaaaaaaaaatggaacttgggaatctgtagcattacccagaggaaagaaaatagtaggttgcaagtgggtgttcacaataaaatttaatgcagataatagcatcaacaagtataaggcgagattggttgctaagggattcactcagactcatgggatagactattaagagacatttgccccagttgccaaacttaatactattcgagttctactatcatttgctgccaaccttgattggcccttgcaacaattaaatgtaaagaatgtctttttgaatggagatttacatgatgaagtttatatggatccaccatctggttttgaaaaaggagacggttcagtatgcaagttgaagaagtctctctatgggtttaaacaatcccctagagagtggtttgagaagtttacccaagctgtgaagggaagaggattcctccaagctcagactgatcacactctattttataaacactatgatggtggcaaaattactattctcattatttatgttgatgacataattgtcacagaaaatgattgtgaggagataagctctttgaagcagtttagctgactagtttgaactgaaagatcttggagttctcaaatatttccttggcatggaggttgctcgtagtaaggcagaaatttctttaactcagaagaaatatattctagacctgttgcaagaaacaggaatgcttgggtgcaagccatcagagactccaattgatcctaatattaaattgggaattgaagatgggaaagaagttgacatagagcagtaccagaggttggtggggaagttgatctacttatctcacacttggccagatattgcatttgcggttagcatggttagtcaattcatgcattcttctaagtaaaaacaccttagtgcagtttatagaatcctcaagtacttcaaaaacacccctggtcgaggaatgttctttcaaagaggacacaagaggttgattgaaatctatacatatgcaaattgggctggctcggcaatggacagaagatccacttcagggtattgtacctatgtctggggaaatcttgtgaccaggagaagtaagaaacaaacagttgttgccagaagcagtgcacaagcagaattttgggctctagcccatgatatttgtgaaggaatctggttaaaaatacttcttgaggaattgaagatctcttattccctacctgtcagattgtattgtgataataaggctgctgtcagtattgctcaaaatccaattcaccatgatagaactaaacatgtggaggttgatcgtcattttatcaaagaaaaattggaggatggtagtgtatgattgtcatatatacctaccaaagagcagacaacggatattcttaccaaaggattacacaagcccacctttgaggatttgattagcaagttgggtatgattaatatatatctcccaacttgaaggggagtgtagaatattctagagtattaaaaatagttgtggaatattctagagtattagaattagttgtggaatattctagagtattagaataagtggtggaatattctagagtattagaactagttgtatataatgaaccctttgggtttcaatctgaatgaatgaaaaagagtattcacatttcaatagtttctcatggatcttacatcttacttctctcaaactatatcctctctatgatctctctgatttctctcaagatcttaagttcatttgttggtgtcagagctgttttggtttggttccattatgtgagccctcaagggagcttcattatttgtgagagcagttcacttttcaatttgaagattcggtaacaatttactttagtgcctaaagctttaagtttcaaaggggttttctgtttcctgtgtcattagtggtgtaagatgggagacaaaggctgatagtaatattggactattagagtagaagagtagaattcccttttctactctaatatggaccaggtttaagttgttgaccattttttaccataattaatgagaagacctataatgtacattctatcttgaattcttgtgtaggttttcatgcttatcacaactgcattattttttttttttccaattcttttctcatgtggttgatgcagatatgatagaaattaattttaactttttcaaatgttatgggtagcctcttcaactctggctatttactctaatacttctcattcttcaacttgatgttatccaggtattgcttggtcttttgggggttttgctagttatgctttctgtccttggatcagttggatttttcagtgctattggagtaaaatcgacactaatcataatggaagtcataccttttctggttttagctgtaagtctttgtttttatcattaccaagataattttatgaactgccatcagagataccatatttatcttatataagtattatgcaagttgaatggactaagtgcctgtttggttgtattatagacagaagaagaaaatacaaagccactgaaatctcttacaagaacagtatttatactgctgagattcagttatgactgtcaactgactaaggctaacagttaactaactacagtagaaaaactaaggttagttattattatttacacttacaccccccgcaaactcaatggagctgagaaaccaaaggtagctcatctacattgagtttggagctcaaatatgtgaacctagtagaagacaaaggcttggtaagttaatctgcccattggtctgggcctggtatatgctgaaccaccagctgcttagtaagaaccttttttcggacaaaaatcacatccaactccatatgtttaattctagcatggagaactggattatgagctagctgcactgcactggaattgtcacacagcatgataggtgtagaataagggactgcaagttcctggagaagagtctgaatccagagaatatcagctgtggcagcagctaaacttctatattctgcttcagtactggacctagaaaccaccttttgctttcttgatcaccaagacaccaggttaggaccaacaaagacagctgcaccagatgtagatcttctgtcatctgggtctgaagcccagtcaaagtcacaatagcctctaagagaaagatggttattaagagaggcaggatacagaataactccagaatgaagggcacctttaaggtacctcaaaatccttttcacagcagtccagtgagactcaagagaagccataaactgacatactttgttaacagaaaaactgagttcaggacgagtgattttgtaacattttgcaaggctccaacaactgatctgtaaaaggagggatcttgcagtaaatcagagccatgttggagagcctgcagctagagttcataggagaagaaatgggctttgcttctagcatattggttttctgtaacagatctcgaatgtacttggactgagtcatcaaaagtgctccactggataatgaatgaacctcaatccccaaaaaatagtctaaagagcccagctgcttgagagaaaatgaagcattgagttgctgaattaacttttgcatgagtgtaaatgaatttccagtgataataatatcatctacatatactaaaatgtaggtagtggtagaggaagtcttgtaaatgaataaagaagggtcacatttactgtcagtgaacccaaacttcaacaaagtcatagcaacaaaccactttgtatctcagagcttgtttaactgacttggcttcagtatgaacaagaagtaaggaaggatgaattcttggctgcactatgtcagctttggctgttgtaaccataggatgcacattgtctggtctgacatgagcaggttgtggagtattgggagattcagttggagacaactgaagagggtcatcagacagcactgtatcagtatgaacagaggcagaagaagccaaatgggagactgtgcaggatcataaggtcaggagacaacattatcagacctggaagcctcaacagaaggtgaagagtggggagcctcaggagaggatgaggaagaaggattagaattgagcggaggatgagaaactgactcaatgacaggtaaggtggttaaatgaactcagtaggtgtagaactggaagtaggagaggaaaagagagaaggataaggaaactgattttcattgaaaataacatctttggaaatgaaaattcactcaatcactggctaaacactaaacaaaggttgatgagatgtctgtcctacaatataatgccacacaatatttgatttcataaccaccaaataatttcttttgttgagtgtttgcaatgaaagtgggcctcaacgattttgttgatcgtttgaaagctcatttggtggctaaaggctatttccagacttatttccttggttacattgacactttctctttggtggcaaaaaattgcttatgttcttttatttctaaccgtggatgtcatttttgttggcctccttaacaacttgacatcaagaatagctttcttaatggagatttataggaggaagtacacatggaactacccattggttttattgctcagcaggagtttggcctaagtttacatgctttgcaaatttgtatatggtcaaaagcaatgtccttgcacttggtctggatgttttagtattgtattacaagcctttggcatgactagaagtgaagccaattattccatttcctaacaatgccaatctcttggtcaatacatttaacttgtctatatagaggacattatcatcaccaataaatattaggatgatattgaatgctcgaagcagaatttgttcaagccttttcagtttaaggatgttggcaagcttttctctgggtatagaagttgcacaatgtggatttcctagaggaaatatgccttggatattctagaggaggctggcatgaccaagtgtaagcatgtcaatagacccatggctcccagcataaagcttttaccaagatagaggaagccattaccagatcctaaataatattgaagaatgattgggtaactgaactttctcccaataactagttcaaatatttcttttgatgtacatgtgactcgtactaggatgccactgttcaggtcttagatacataaaagagctataggaagatggttactctatgactatgatgatgctgatccggcagattctcctttaggcattcttcctcaagatactgctttcattttggatgtaatctgatatcttgggaaagaagaagctgacatcaagcaatggcagttgcaatgcgtgaactcgtatggctaaaatagtttcttaaggagttaggtgtttgtaaagagcaattcatgaagcttgtgtgtgataatctagcttccctgcataaagcttcaaatccaaggtttcatgaaagaataaaacacatttaggttgattttcattttgtgagggagaagagccatcctggagctgttaacattttcaccaaaattctttgaagtccttgagttaattatgtatgaaacaagcttgttgcatgactcttatgcaacaactttagagcaagtaatataatgttcttagaatttgagtttgggcctaactcaacactaccaatctggcttgtaaggtgagggatgtccaccacttatatactttaatttggtcgtttcactagtcgatgtaggatctccaacacacaccgctcatgccaaggactagacatcttgagcgtgaagtttgcaagactggacatctgcggatgttctgataagtgataacagactaatagcaattggcatgataggcccaacaacaatcgctaagataacaaatgttattataattattagaatgttggaaagtaaacattaagaattgttatatttggttcatgtcctttgagcaatagtgccataggaaatagcttaaattcatttttttttgtcttgtaaatactctcttgatgtatataagtatcatacatgctgactgctaaagataattcagaacctttcttctaaatttgggccattctctacattcaagttttattaatttttataactctcctgccctgcttacttttctgcaagtgtggttagatttcactttttgtttttttggattttcatttttttgatcaggttggtgttgataacatgtgtataatcgtagatgctgtgaaacggcaaccctcaggtttacctgtagaggaacaaataagcaatgcaatgggtgaagttggaccttcaataacactggccagcttatcagagattctagcatttgctgtaggatcatttgtttctatgccagcatgtcgtgttttctccatgattgcaggttacagatttttctcctctcaccctgtactttggacaaaaagaaaactgaatcgacatcatctatacacataaaaaggagggtgaaatatacaactcctttaaaaagtggttttaagatttcttaactcctgaattttcttttttatagctttggcggttctactggacttccttctacagattactgcttttgtagctttggttacattagactttatgagggccaaggataataggattgattgctttccatgcgtgaagttgaatccgccctctgcggagcaaaatgaaggtacatctgagttatggcatgtatacattggttttctgctaagcctgcatcttacagtttaggcttttgggtattagggtttcaaattggtatagcctttatgaccatgttgtcaataagttgatcatttatgctcctattcttatgcatctatgatgggcccttttgctttgtctacgcttcaagcccaaagctcgtttgcatgaggggtttacttggacttataaatcattcttgttactctatctaataagccttaagcttttaggatcgggttggtctttgacatgatatcaaaggctccatgtagtggttataaatttgatccttgttgtccttttttggcttgttgagatttaatttcagcactacgtatgaatgttatgtgatttgtcaatgcttcaacttgaaaggactctcacataatgaaacatcaaacatgttaaggatataaatcactcttaagtctccaccttgtagattaaacacattcacacagtttatatctaacatttccattgaagcataatcatgaattattttcagcttctgtaggtactttgtattttaaactttttctctctccttgcttatatatggttctaatcatatcctaatcaaagtgtaggtgttaggcgggaaagagatggattactgacacgatatatgaaggtaaagttatatttagttcatgagttgattatgtgtaaactaaaaaatgatttttattgtattacccatgttttatgaattcaattttgttgttttctaattttatttggcggtcataggcaaaaaattctcaacataacgccatataacttttacattgttagagtggattagctagataaataggggggaatttggatggaatgggcattcagttagttagaacatttgtaagaaaaagagaaatcatttgtgaaagagaaatcctaaattatttacatatttacaacatagataatatatagtgttagaacttaaatgtaataattttatattcaaaatagataaaacaacttaatcattagtctcgtgaaacaaaattataagttatatgagtatatgaaacctctattttggaagatggaattgaagaaatgaaacaaccaattagagtgcatgcattgaatgagtgagtgacaaatagagtagtggaataatccataagataagctatccttcaattccttttcatttatcaatttaagcttatatgctcttcgatttctttcatgagaattggtgaaagaaaaggaaggataaataatgaacattgactcgtgtgattattgcaccaattcgttaatggataataagattcatattcatttgagattcatcttatgatacaaattgctagctagctgaatcacatgattcaaatcgtgaattgtaatattccaataattatgatagctgccctatcaggactagttagttagttagttagaggggattaatcatataaataagggagaataagattcgaaggggcattcaaagaatttgaagatttgtaagaaaggaattatcctttgtgaaagggaagcagcccttggacaagaattacttttccttgttctgttcagtttcaatccagaaaaattcactctttatttccatcttgtgttcctatcaggctatcacttttctgatcaaaattaactctactatcatcgtgtgaatttaggaggttcatgcaccatttcttggactatggggagttaaaatcttggtcattgccgtatttgctgcatttaccttagcaagcattgtaagtttcttgggaaacgagaaaatattaattttcagtaagacccttttcggaaatgtcattctatttgtgctttaattgtttccttttattttgacaggcattatgcacaaggattgaacctggtcttgagcaacagattgctcttccacgggattcctaccttcaggtttaagtttctatttgttttcccatgttccattttgtactagccagcctcttacattcattttttctttcagggttatttcagtaacatatctgagtaccttagagttggaccacccttatattttgttgtaaaggattacaactacaggttgattaattttattgttcttagcgtacttatctctattaattgatgggtcttttaagaagacaattcaatgttgtgttatttacaaacttaaatgatgcattaggcatgcaagctgctgttgaataaaaaaggaaatagaattagtggaaagaaaattttgtatatcattattttcctccactgtgcttgcacgtgaaaaatctcttatagatgtatcaattaagtgtattatctgaacttttgaacttatttcctgtgagtctcttgtgcagtttggaatccaaacacacaaaccagctatgctccattagccactgtgattcaaattctcttttaaatgaggtaattcaatggtcaagttcttcaacaagtgattattagtgtcaacctccattcattagttctagtaaaaactgaatattttattgattgcttgagagaaaactcagtgaaggaagtgtgtaaatgatagtaaatactggaaacaaagaactctaagactaagagattgactgagattacatcaataatatctaaccaatcttaggaaaaaaatatcaaatacagaaataaaataaatataatccccccaagccgtgtcatatatatgtaattctaggacctcttgaagacttggtaaaatgtcagccagatgatctttggagctcatagaggtattgataatgccaaaaagtatcttctctctataaagtggcaaacaacttatgttgtcttctcgtgaaaaaactagatttaatgagatatagggcagattatcacaaacaagctcctaagaccaaactcttaaaacttgcaagtcttgaagcaagtgttttagccatagaagttcacatgtggggtgagtcatggtgcaatactctacaatctagccacaacattctgcttcttactcttccatgagatgattcctctcataagaacacaatagcctgaaattgaatggaacatttgtcactgacatcttttgcccacttggcatccaagtatagtataatatttgtgacccctagccatataaactaggccctttccttgtcaccccttaatgtaccttagtccaaacaactgcattccaatgacattagttcaagaactggctaataaggctccccctgattaggaagaagcttcatattttggtcgtttgggtatcaaatggtttacaatctagcattcctgttttcttcatgtgtgatcgctgtacccaaattgcaagtgttttgctttattttcctaaaaaattaaggaaactcctcatgaaagtcatatctacaaaaggaaatatctctaaactaaaactaatctaatttttatgggttttccaaaaaaaaatattcttttgtggtttatttttgttcaatttttcctttgaaatcatgcacataaattcataaaaaatgaatttatcatggtgcaaactagctgtgctcacactgaaggtagttttgctcatgaagatggtaagacccttccttgcaacactggtaaatctttgggcctaagagactatagagaagttgtttttcatcagacatgttaaaaaaaacaaaaagggaaaacatattttcaatcacagccaaaaaaaatgagaagatggtgctttctaacagctgcaaaagaggcagtattaggacaaatcaaatcctgaaacataacagggagtggccggtgtcctgttctgtggtggcggtggcaagtggtgtacacacacctgaaatgcatggctactggttgcgtgagtaagggaacatggcagatctgatgagagctaaaactttgggtccccatcagcgacgtccgctttgctggagaaacctgctggaaaaaaaaaaattccagcaatggcagtggtggataatggtagcattttctgggctgtgggcacaatgaaggtgccaaggtgaaaatgaaagctacctaagatagctgcaatgaaggctgcctaagatagctgcaagaaggaagctagtcttttgatgcatcaagagtctgatacctacttgataaacctaaaagatttgaaaaagaaagtggctataagagtatagagtatacttactcttacagtggctgaagtttatttcttattcagcttattacaaaggatgattaccactcctatatatagactacgttacttttaattcaagaatttcaagggactaaaaaaatgtccaacactcaagagtctaagaatcttttttttttatcaccataacattgatgcagagtatccaccagttttactaatgattaatctccgccggagaacctaactgaccacctttagtagggtctcccctcccaaccacatttttttcatccacaaggctcaaacccgagaccttgcttaaggggaccgagcccaggaccactcggacatacgacttgttggtagagtctaagaaactgtacaggctaacttatgaaagaaataaaccctattaattacaataattatattcttcatttatattgttgaatggctgacttgtacataactacacttgtaatgtaatttcatttttatcttggcatatatgaatggattctgtatatattgttctgtaacattgcagatatctagagcatcattagtgccaacatcaagctacatagccaaaccagctgcctcatggcttgatgattttcttgtatggatatcacctgaagcttttagttgctgtcgaaaattcacaaatgattcttattgtccacctgatgatcaggtatgtgcttctttaaatgtccttggataatatttgcatgctgcatgctcaactttccttctctcctatatgttttgaacttatattcatgcacattgtatatgtatatatggtttctcttttctcctgccttgtttttgtatctacatcaattgtataaattataaatctaattaaatattgctcaatgtaccatcgtatatttttcgtttacaatagtaaatgtctgtccttgttcagccgccttgctgtttaccagatgaagggccatgtgggttgggtggagtgtgtaaagactgtacaacagtaatatacttctccctctaaacttttttgtttattacataggacactactttcctaatagatgtgactgtaaatcaaaagggtgaattagtaaagcgactgacacttttggttgattcctagtgtttccgccactcggatttggttaatgatcgtccatctacagcacagttcagagagaagcttccctggtttcttgatgcactgccatcagctgattgtgcaaagggtggtcatggagcttacaccaacagtgtagatctgaatggtttgaaaaatactcactccctctttataaaaagacaaaacttatatttatatttgctgtaacattctcaaaattgaaaatctaatatgtagattttgcttataactggatttcaggttatgagggtggtgtcatccaagcttctgagttccgtacttatcacacaccagttaatagacaagtatgcagtgtgataataagtgatgatcttattttctttgctttggcatatttttttcatacatttctctgtttgttctaatgaaaatcttgttagggtgactatgttaatgcaatacgagctgcaagggacttctcggcaagaatttcttcatctttaaaggtttggacgtcaatggcattatgcatttttactgagttgttttggcattctggatcaaaaaatgttcggaatatagtctacacatattttttctccttgtaattattattttttatttgaactgcatttatgagccttttcctaggattgactctactattactgctattattgttattgtgttatttctgtctttcaccaatctaatattttatttgggagtccttgttttcacttgacctttgagtctcaatctctgttggtattagctcatcactttttatctgactgtctctttgttggtattaagtttataacaaaatattagatgatatgattatggatctacttaccattttctcatccttatgaagcattttgtaatgactaaaatcatacaatgtctcatattgttgattcttttgtggatcaccacttcttgttgattaagtttctcttgtgcagatggatatttttccgtactcagtgttttatatcttctttgaacaatacctggatatatggaagttagccctgatcaacattagcatagcactaggttggtattccaaaacagtttaaataacacatgcacacagtatgagatactcgtttgtcaaccttgttgtataagctggactgtctgttatgatccttcagtttcccttcctgtttgcagtttatatgttgaaatttaagcctttattgagaagatttatacttgtgttcttggcttcaaacttttaaattctatctctatggtctttgatggagtactctgttgtcttatcaacatcaaaccactttatgttttccacttgaaagatatataggatcttctgttgctttttatgtatgaaagatttcagtatcgggatttagactacatattcatgggttgtacttatttgcctccctcttgatatttctgattggaccaaaattggaaagtgaaaatctaattcgtgtcttctcacttttttccatgttttgttttccatttctcggacataaattcttcaactactacttgtgtgaaaatgtatcatatcaagtctgtgtctttctttagtcaaattcgtttgtcattaaataacttatggtgatataacaggtgctatttttgttgtctgtcttatcatcacatccaggtatactgagccttgtatatttacagtcaacttgaaaatttgttctctccagttcaagattaagcataatattctttttctgtttgctattaaatgcagcgtgtggagttcaataatcttattacttgttctgatcatgataattttggatctcatggtaacatttatcttacagttgcaaattcgtttcatctttcatttgctttccctttcaatatcctatttattacctcttagttacagaataaaacaaatgaactttgtgactcctgcagggtgtaatggcaattttgggtattcaactcaatgcggtgtctgttgtaaaccttattatgtcaataggaattgctgtggagttctgtgtgcatatagtacatgctttcatggttagtctgattctctgctctatgaattgacgggtcttcccatatggtacggtggtctttttgaggaaacagtgatatttgtcaatgtgtcactttataattcctataacatgtgaaattcaatctgctttgtcaccagggaaatattgacacactgatttattcagggagaccttttatgcaattgaaccacctgccttttggtgactatgctgtatgcacattttctgatgatcttgtatacatgtgttcacaggtaagcttgggggataggagccaacgagcaaagacagcattgtgtaccatgggggcttccgtattcaggttgactgtatgtatagtggcatttggaaagatcatggattgtaatatttgtagccttaccccacccctccccaccccactatgtgcattatttttggccatatcactggtcagtgggatctttaacaccccctgttacgcagaggactggacatcttgaacatgaagttcaaaggactggacatctatgggtggtccaataacagcccgataaatccaacaacaatcgctaggataggttctcataccattttaaaatttaggtttacactataggctctgttaccatgttagaattgggtttgatgggtggataatatggtaggtgacccaataatggaataaggatagactcttgtaccatcttagaattttgagtttgggcctaattctatctcaaaaccaggttgtaaggtgagggttagtgttaggctacagttctaatgtaaggaaataaatggagtaaataggataataagtctctgcttattctcattcactgaatggtatttaaagataaatacatgcagaggatctgctgtggccaatcagggcccctttgcaatagaaaataacagaattagatgctgaatttgtggatgaggcagtgagaatattcagttgctttgtctttatctgggctggtattacttgtagtcactgaggtgtgttgacctcttgatggtcctcgttggtctgctggtgttctctgtaatagcagcgttgctatcagttagtggattaccccctaattatatacactattttgaccatatcactagagtgacaaaacttgaggacttccggttgacaatgcatacccatatgatgttctaggtgaggaccttgtttgtgttcctgggtggtatatactataaacccagttggaggccacttactcggtggtatgatagttattattttggaaacaagtttataggttgacagggccactaaggtggatgttgccagtgttttgttattgagggaggcactagtttctaagtttttggattagatcacgtaattttcgtatgtatctaaatatgtatttttacatgtatcgtatcctatatgttttaaaataattgaaccacagtaaccaccgtattggatgcgtatcaaatttgtgcatcaacttgtaacataagcataagcttgagggagaatattaaaagatatgaaggttgttagtggtgggcctaggctagggtttgggcttgtactggtagttctaaaactcggtctttttaatggtataaataggtgcatttgtatttgtgtgtgacatcttagtatcaatctcaaaatacattgtttgccatcatttgttctttccccttttcctcgtcttaaccctaaaggttcagcaaagatgaaatgttatgcgcatgattaaaagttcatcttatagtagttatttagtagtgtagctttgatataactcttgatctgttgtcagagaattgatgcaggtataccatttataactaattacaaaaatgatttgaatcgtggttgaattattagtgtctgcctgcactattattttgttgacactttctttttgtattatttatctttgtttggtagtggaatcacacttacaaaattagttggagtcctcgtcctttgcttctcaacatcagaaatttttgtggtatgtgacatatcacccttggctccaaacttgattgtctgctcaagaaatgttaaagtaccttttgggtctttgcaggtgtattacttccagatgtatctggccttggttctcattggcttcttacacggtcttgtgtttctacctgtaagtttgtggtgtttggtgttgctctataaagtataaataactagcttttcattaacgtcaggaaataggttttgcttcgattccattttgcgagttttaattgttggtcacacttggcattcaatttcacaatgtgttcaacaagccttacacgtttgacattgtcattaatccatacaatccccactgggattagttctgccggtaggaatgaaagcactttacctatacggcttatgttcaattcctactgccagcaatcctctttggtggacaatctgttaatatttagcaccactgtaagcccttgctgaggcttgtggtatgttttgaccttatataggacagcctacctttcccctatatgtaacatccctgattttcgatttttcggcgactcacattacggtacttcactcaacatccttgttaatcagaaccctccgtaggtagccatttccaagacctcgaaaatgagttctgtttatttctaagatcaatgactgatcccacaaaccaatacaagatttttcagtgtattttgtcctcattcacatgctttttgggaaatttcccagaaaatcactcatctcattactactccaagtgaagcacgcttaactatgaaattcttaagtgatgggttaccgaaaaatagatgcatcttgttggtatagatagtaccaattaatttttttaagtcatcttcaattgtacagtcacatacctatacagttttcggatctctctttctagtgtgattcgtcgggattctacactatacctttttattcccaaaaaatatacgtgcacaataactaattagaaaacatctcacatttcctgcccttttttttcaggtggttttgagcttgtttggtcctccgttaagatatacagtcattaaggagcagctagaagacatgccttctgcttcatcagaacagcctctaattagatgaaagttagattttaactacgtgatcacatacttaatgaacaagaaaatttgttttgattatagaggattaatattatcttttcgtttgacttttagatcgagaaagttcattgcttatgtatctgaacatggtcacggagaaactctgctgattttttgtaatttctgatgtttggtaggtttgatcatcagttacgttggtgtgtatataattccgagaacatttgctgatatttgaagcaaatatacgtttataaatattcatatacttttgtttctttttaattattattaattggctactgttatcattcttaaacaatgaggataccaccaagaaaatcaacttatataggattgttttactttaatcatgataaaaattacgtgaccaaatttgttatggcgctgttaaattgtctttagtattgatatcactacacgttgaacgaaaaaggaactatatgtggttgctttgaggagaacggtctcattttgatgagatctacattcaactcaagtgtagttcaaattgctaaacaaatatgtatgtcgttccatgaaggccgaacatttgtttgagtggccaaacggtaaaacaaacatacccatgtgttctaacaatcatcaactaacaattcactttccattcagatttctaataaatggctctaacaaagtagtcagtgaagctatttgcaatgtatgacgtgtttcattttttcacctatttttttagtatgcggtataaaatcaaaatatttgaacattcaaataatataaatacatcttattgacatccttcatttatatctatttttctcttttttgtcatactatgttattattattattattatatattcattaaaataacttaactgaaaaataaaactaaatgtttaatataataaattaaatcatatttattggtattttttcaaaaaatatttatagcaaattaattttgtccatctaaaaatttgaaaatttgattttagtccctaaacaaattttatccctcaaaatacaaaatattgttttaagaaaatgtataatttttatcaaatgtttagcacattgatatgattgtcacgggcaaaagaacctaaataatacaaattaaataaaaaattacgcatttggggcggttttgaaactatttacaaatctggggcagtcggaaccgcccagaattgggcagcactggaaccgcccaaatccaggtggtaccaagggggtagaaccgcctggatttgggcggttccagtgctgcccaattctgggcgggaccaattcgtgacacgtgtcagtcctgcacagatggagcgatgcatatataaacttcggacggtcataacttttgactggaatgtccgattgaggcgaaaccggtggtcacgcgttcgaaattgagaggagaaggcgctggcaagtttccgaaggggacttggtcaaaaattttctcaaaaaaggcttctaagtgcctcaaaattgggttttaatcttcgaacatcccaaaattttcttgttttctaatttttaattatttattcagttaattgcatgctattttttatttttttcattacttctatcaatttcaagcatttcgacatatcgtacacctcgatcggacatttctattaaattttttttaattttatatgattttatttaatatattttggattttttgtatatataatttttaatatattattttatttaatataatttctaaatttttatatgatcttgtttgatattttttggattttgtatatataactaatttttaataaaatattttattcaaaaaaaaacttttcaattttatttttgaattcgaaaaaattgaatatttttttatacttctcattttttatatcgagactaaccccattaaacacattattctcatcactctcatcatctctttcatcctctcataatttgataattgtctttcaaaaaaaatagaagacaatttcccttttctctttttgttccagtcaaaagcacgcagtcgattaacccgtcatagaaactacactgaaactcagactttctgtcaatcggtgactcaattgtataaaattagtgtggccaaaacatatacatccaagcgagaaagagaattagaaaggatcgtccatctttcatggtgaatgatcaattgtgtgagtaagttggtcatcatctttatctctctgggtaagcgcaatgcaattctttgcatttcaatttgattcactttgtctcacgcagagccactcctatttctagagttctgcaatgtttccccgctccaagtgcgctttggaattaatggggtgctacaatcccgattattgtgtggtgagtgcactttgggacgaataaataaaaattatattaaatatcaaacaagatcatataaaaatttagaaattatattaaataaaatgatatattaaaaattatatatacaaaaaatccagaatatattaaataaaatcatataaaattaaaaaaatttaatagaaatgtccgatcgaggtgtacgatatgtcgaaatgctcgaaattgatagaagtaatgaaaaaaataaaaaatagcatgcaattaactgaataaataattaaaaaattagaaaacaagaaaattttgggatgttcgaagattaaatcgcaattttgaggcacttagaagccttttttgaggaaatttttttgaccaagtcccctttgggaacttgccagcaccttctcctctcaatttcgaacgcgtggccaccggtttcgcctcaatcggacattccagtcaaaagttatgaccgtccgaagtttatatacgcatcgctccatctgtgcaggactgacacgtgtcacgaattggtcccgcccagaattgggcagcactggaaccgccaaaatccaggcggttctacccccttggtaccgcctgaatttgggcggttccagtgctgcccaattctggacggttctgactgccccagatttgtaaatagtttcaaaaccgccccaaatgcgtaattttttatttaatttgtattatttagattcttttgccgattgtcacgtgtcaaataactttttcatttttatttttaaaaaaatatttttatttttataaaactttgaagtttagttttagcctctataaaatttaaagtttcattttaatcttcataaaattcaaatttttgattttaatcctcataaaatattatattttatttttttaacataacatattaagtaatattaatcaaaaatagcatagtattcataatttaataatattattggtagggtgaaaatgaggactcacaacgtacatactcatctttgttactagcctacctaaaattgtgttaggatcatttatgcgtgaacccaaatctaacatgatgaagaccaaataagatatgtgggataagaataggtcaacttgatttactaacgtaatatattaatattaaatgtataattaaatcgtggattaaaagaactataaagtttaagtaaaatatatttgaaattataaattctttattattgattaaaatttaatctttaacatactttttattattgattaaaatttgttgaaaaatatgaaattatactttaagtgggtctcataaaatcttgtaattttcaataaaatcaaccaataataaagaaggatgtatttaatagagtgcgataagaaaatatattgctagcatctcttaatcaaatatgtcataacgttgaagtttaacgacacactagcaatgattctatggcaatcatgtaaaaattaaattgaattcccttccaaaattttcagtttattgaatcattattctttaagaaatcgagccgcaaacagtttcaagagccgacttaagtcccttccaaccccacatcatttcctttgtattaggagagagaaacaatctaatgcagcgggattactttatttatatgaatataaatttgggttatatatagatatatagttggatggagcaactaatatggagctttgtgaataaagtgtagataaggtaatgttagaatttgaagaacaaattaagtagaagtaatagatataaataaaatgagtctaacaagtaaaagcaaagcagaaattaatgcaaatgtgatggtacagtactaaaaagaaacgcctagggtggaagaaggggtagcggtggtgtggggaaaagtaaatgtatttggtagaatattaagaggagaagcttgaaagagggcgagtctaattgtgcggctctgagatgttgtatgcaagtctttacactcctcaagatcaccatcgcaggctaaaacaacccactccccgtcatcatccaaatactttagaaccacgttgctgccgttgctcacatcgtttaggttgaagcgccttgcgatttccagctgcaattctgtgaacccccaatgtgcttgcaagctaaaacggattttttcatccgcaaaagtagccttcactctcaagggttgttgagggctttgtgctgctactgctgctgctgctgctgctgtaggagaagatgagttgttgttggacttggatgattgagaactcaactccggaaaactgttgtagaatgagccgatctgtatggcaccctcggcaccctgcacggaatcgatcacaagttgaagtttcttcaaagagtggcccaccttcttgattttccttgaaggccacctcgttatgccatgctgtctgcatatccttttcagagttgtgggacacactgcatgcatgcattcattcattcattaaacaagagctagagtagagagagacaaagaattaatgcaattattaatggatcatatctctcaccgccaatgctctttgccgcatcttttaggcttcctgcaaagtactgtcttagaacggccaagctcatagtcttctcggccttggttcgtctcttctcgcctggttttctgccacgcttcccactaaatgtgtgtgtgtgagtgtgagattcttccccaaacacgacctggtcatgtgcctcataagtactggtggcagtactgtcccagttgcagtagtgagttgtggtgactttgaactcctctttgggttcttcttccaaggacacgcacacacctttgtgttgggcctgggcctgggcctccaccatgtgtgcaacccaggaggcctgagatggggattcagtgggcaagaatgcagaaacatgatgatgatcctggatgagagcaagatggaaggtagcgaggcaagcttggtgaaggagaatggataaagagttgaggaagtggttgtggtcaggggagtctcggggaaggaagaactccaagacgaaatgaaaagaggcagtggaagtagttagaggaatagcgacggcggcatgcaagtcaaagagggtggcgtggtgagagagaggatattcggcgttggagaaggcggttatgtcggtggcgaaacagggcttggctgttgcgaaggcagtcccaacaattccttgtccgcggaaaaggtgatgctgagagcaggcctcctggaagcccaagaggtgggggtgcccttcccccacaaagcacgctctctccacagtcgacacgtagttctcatcccttgaatggccgcaggacttggcttgttgctgttggacgcatggagcccatgccagagccaaaggcaccttctgcgccttgcacacacacctcaccacctccatcatctctccaactacctcatcctccatttcaatctggaggacacccaggcatctcccactccctctttccaatacaggaacccccacacatccctcataagggtactcgttgcttctaaagaaccgaagcttcaccttcatgttcctttcaaaagcaatcgaagccgactcatcaggcccaggcccaggcccaggcccatgttcatggcctgtgctcctccgcagtggaacccatatctgaatgttgttgtttgtgtattctctcaagtattccagcgcagcctctagtctgtctttgacggaggaagatggccctggattagcctttggtccaatccaccatgtcttccccatgggcatggcctcgctgctcccactcgtttctacccagcaaccttgtcccagcaactcctcaatcaactcttcttcacactccgaccagctcccaaacgcgccatactccatctccatgcttcctcgatcctatcctatcattttacatttcataaaacacttaattatataagtttaatcacccagaaagaggaggagccatcaagtgctaactcaccttaaacttaagattgcttgatgagaaaatatgattacctcaactcagctcagctccactcgacatgcgaccgatcgacaagcctcttatataatgaccagaaaaggaatggaaactctttctttcttctatttcagtaggacccaccgttaagcaaaaaccagagagtgccccctcagtctcacatctctcaccgtgtccggtatttatttatatatacatatttttcccttgcttatcactgctgtaaattatacaattatatccttcatgtatactatatactatatgctctgcttcctgtattacaaacaacacccagcaaattaaaataaaataagatcaagtcattctcatgatgaaagcaacatatagagatgaattcaagttactgggtatgtttctttgagattatttttttaaaataaaaaagtattttttttacttaaaaagtaataaaattaaatataattttacaagttttcaaggaaaaaattagtttattattttttataagttaaagatatttttcatagaaaaatatattatgtaatatattcttatattataaatttaagccttcacttgaataaaggttttttaagattcatcatgttcgctaaatcacataacttctcctgtattaatttttttttattcctttcaaaatttattacttaaattcatttttaaatttcacataaaatcgaaataaagtttttttaaaaaaaattggacacgtattaaattaatagatatagaaattgtgttttatttgaataattgttttcataattttctttttaatatattttttatctcattaattatgtatttctatctaattggactattccaccaagttgattaatcatatcaagcgtctatgtcttttaaactcaaaacttaaggaattatagtgtctatagttagatacacacagactgggatacaaggtaagggttgaatccttgcatatggctgaatccttaaagagttaaagatgacccagatcaagacaaacaatcattatgccatgaatgcaaagaacttaggaccaattttgctatcctaaaacctttttatcacgtgagtaaggggtcatacacacctatacacttacgtaggagtaatgtgatacccatcactccttgtatatatgtaagtagaaaacgatgacaaaatcataagaaaacacatgatataaataggtgtgatatattctcattatcacactcaagttaagtagaatagatttcattaaggtttcttgattctttttaattggaaaaattttcaaagtgtgttttctaacatgaacactaatataaaataagatatttgttatagtaatgaaaatatattattatagtttattgtaattttctgtctaaatcaatcatagatattttttattagactcaattacattcgagtcaaataggatcacatactataaacaataaaatcatttatttaactatttaacacaattatatatctaatactggaattcatcaagatctcttattaagttgaaataacttcatatcaattaattagtgtgtttggtggtcgcagtttattgtatttaagatacataattttatcacatattgaatataaaataatgacattttttatttaccaatttaaatacttttgttttaaaatttactcaaatataaaatatccgtaaatacatggaaaagtaccttgtttattaactaaagaaaactcaaagcaacgtaccttacttgttataaaaaaaaaaaaaaaaaatgattgacaggagtgttgggggtgctagggatgtctgtctggccattaatgaattgaagtaagctaaagtagcacctctttgtatgtataatatttaatatataattatgcatgaccggctgtataatagtgggagatcattaggatgaagaatctgcactacagtctacagcaccattacttatgaccaaaacaaaaagaatatatagagagaggaccatgcttgtgcgccacatgccaatcctacagcaaaccagagatgcgaaattgcttaaagtggcaccacatcgccgaaacaaatttatgcttcattcaattttacccatacaagtggatcgcaacaatacttaagcttcattcgtcgattcggaattcttagattcttttttaattaaaaaaaaggtcataatatattaattctaacgtccaagttgaggccgcgaaaattgaaaaaagattcttctctgtttcattggtgaattcattgacgtaatatgcatctccaattcctggctggctagctccatcaacatggatgcttgggcccttttttttatataaaaaaacgtaaccttatttctcacactttttaagataaacagaaaatgtaaccttagagagacatttttaatcataaatgatacttaggacatttttcttttttttcctccatcatattaaataatatatttatatttattccttaaatcatttcatagattcaaaataccttaattataaactcgctaggatcaacctatataataatagattaaaacaatatacatgaaataatagattctaactttgtgcgatcattttatatatatatatatatataataaaaaaataaaattgatcagtagcaagcagtgtccattgtaacatgaaagaagaaaaaaaaatctagcatttggaatataatattgagattgtctccacctacgagctgagtactttttgctatagcttgaactgttgacgttgtaaataaattttacatgtataaaaacaataaataaaaatcatatatggagaaggatctataattctgacatgtgtcgtgaaatgggtcaccgtacgaacaagaccagccggacaatagagtttaaattacttttcaaccaacgggatatacaacagggataacttcttagctcgcagtaattcgtaatcgcattctttcaatgttattgcgaaagctacgttttatcgttcaaaaaataataatcagtacgtttttgatagaaaatatgtacagtatttaaatataattcataattaatgttaatttaaatatattttaagtaaatttaattattttaaaattaattatatcagaaataatttttatataaccttaaaaaaaaatcttgtcaaacatattctcgtcatccttacaaattagaactcggttattctttattctgcataaccatatttgcctctgataaggattgaatatcaatttacgattacaaatcaccataaaaaattatagaataaattatacatatttttttgagatttaaacaaattatatatgtttctctttatgtttaattaagaaaattatacatgtcttatttttgtttttaaaatttacccaaatcttcctaaatgtcatttaaatatttgacaataacaagttatatgtattgataattatgacaaaaaaagattcaaatatattttttgtccccataaatataaaaatgttcaaacaattttttttgtttatttttgtcctcacacaacttaaatttgttactttttcgcttagagctaggtttgaatatatacaacctaagtgtatgctatgataaaaagtgttaggtttttaacttttttacatccaaatctacacatatgtcgttgtaaaaagtgttgtatttcaacttttttacattgtgtatacatataagtgatttaaaaaatttgaaaattttaacaccttttacaacaacatacatgtattcgaacctagttccgggggaaaaataacatattcaaattttgtgagtacgaaaaatagataaattgttttgcagtaacgaagtctgaacattttcatattaatgaggacaacaaaaatattttagtcttttttaatcaaaattatcaacgcacatgaattattattgtcaaatatttagacgacatttaagagtttgtgtaggttttataaacagaagaaagacatatgtaatttccttaaatctcatgggaaatatgtgtaagttaaaaaaaacatatataatttccttaaacatgaaaagaaacatgcataatttactcaaaattataataaagaaaaatgaagaatgaaagcaaaccaatttaatattcataatggatatcaattttacttcttctaaatcctaagatacatacatatcatagataaatatgtcaattatgaaattttgtatttcactttttaataattttatatattatgtatttaataaatataattttttaaatcaaaaatacatattaccttgtacaattcgaacaagaatgttgaaatgttttttttccatttttaatatatattgtgttaattttgacatatattaataataagtttaaatatatttttgatccctaatatatgttcaaatttagtgtttgtttcttaaaaaaaaaatatttgcatttgctcctcatacttgaacaattttgatactattagttaaatgatgacatgtccattaaacatttgataagacgatttgtgactactctagaaaccatcataattcatttcaaaatttaaattacaatttctgacaattaaaaattgctaaaatcaatgaaagtaaaaatcaaataatttttttggcaatgactccttcctcggcctaatccatatccctccattcataaaatgggcaactggatcataaaaattacttctgctaccaaatatgctacccatatagattagtatttcactctagcattgttttcatttcaattaatagcgaccaatcaatcatccaaggggaactccataatagacgtaagagaaatacacttagagggaatgtaaaaggttgaacaaccaatttaaatattggatgcaaggtgacaaagcgatgcaatcttcggtggaggatgtcttagatctaggtttcgaggcgaaaaatcatgatcttggcattggactaaacctgagtggtgtcgatggggaggttctacttgatgccgatgattgaacttggacaacggcaacgagatagttttgctcaatgttggagatagtggtaagggagaagccttggcatatgaggttgtttctagagagagatttatttgttgatacaaatctcaagggaacaaaacttgccacactagtaagggaaggtggcctcttttgcatgtgagctttttttattactttaattgattctattggtttttaaaccataccgccaaaagttgtaatttcattctataaataactactgttagttttaaaaacaccacaaattatccttcaaaatagctaatgaacatgtcattacttaacttatggcagagatttaaaataaaatttttcaaatatcagaaagcaaatacgaagaaaaaaattattaaggagcgaatgcaaaattcaagtatatattaaaaattaaaaaacatatttaagccttaataatatatataaaaaattgaataatatttttttatatataacttataccaaagaaaaaatttttttacaaaataaaaggaaatttttagtcctacaatgaattgaaataaatttatccattgaaatattattataaagtataagaatgactaaattaacaatttatcaatcgttgtacttgactcatcactctaactggctagcaaagtttgagtcgaatagtttagaacctttcgcgttttggtcctcttgtaccctagaggcaattagtttgtttagttatgtttttctgtgctttggctttgtatctttttcactgataaaaaaaaaaaaagtacttgactcatcactttttaaatgtcaaccttcaattcatttgttgctaaaagttattttcttttagtggatgtgtgtgtgactaattaatgtgtatttgtgtttattaaatcaatctcaatatttcatcggagttactattgtttacaatatcccgataaattaacataacacaaattttttacaataagagatgtgatacaaatacaaaaattcatataataagttactatacaacatcatttttttctatctttactattttcttatttattaaatttaaaatttaaagtatttctctttatttctgttggttcattgattgtacactttgttgtataattttttatacaattattattttctttaagtaattaaaagtttataataaccagaaaaatcggaggacaaaaattaaacataattatatttacatatagtaattaaaacatattttaacttttttcttaaattttcttttcaccctaatatgtttaaatataattttgatttaatataattagttataatattaataatcaattgttgacgcaatcaattattaaaagaatttatttttaactaagactaagaaagcttagcctactttttgtcgaggtgggtcattgttaatgcgcttacgcatgtacagtaattactaattagtgaacggagcaaagaaatcccttttaacaaataggtcggcccacgaatcttcttctttcaatttctgatgaattaaaaataatataaaaatttgtatgataaagagaaggaaaaatatatttgaaaaatgaattgagaactagtgcaacaggaatacagcacattaagaacacacacaaaaataataataataaaatacagtattaacgcattgaaattaaagtatatgtgcgtagagccaacctagcctacaatcgaataaaattgaactgatattagttctcactaactttgagcaatttagttcttgtactttaaaagaacagtgatttttatcattcgttacaaatactataaaaagagacaaaatctactgctttttgtaaaacttaggatcaagttgaccaagttaaaaattcaaggacaatacagaaattaaaaatatattttacctaaaatttaattatagttacagagtttaaaagattgagccgcttcttcattttggcgagaaacaaaaatagtttgtcataaactggatgtactttactaacacgtgtatcatagataacataatatataagtttagtattattttttgtttaaaaataatctcactttaagacttatctatgcgaataagaagttattaaatattttaattttaaaatataaaattgctctattatattagaaagaaaatgcaaattaaccctttaaaaaaagtctttatattttgaaaatatgcaatatatcttctccattaaatttttccttagaaatgaataggttttgtagattcgcacgtgactcgatttattccaaaattatttataggaaaatataaattactatcttgaaatttgaataatatatgatttaggatttgtttgttttatattaaagaaaatgtacttattgtgatagatttaaaacttagtgagtttgagtaaaagtattgatacactatttagtataattacaaaaatatttgccatttatgtaattaagcaaattttgttggctttttcattatttctataggaagattgattccaatccggattgatatttgtgatcttgtatgaatacattaatccttagttttgggacatactattaaattatattaattatttaaataaatattaaatatttttttactacctcctcatatgcatatttacctttttatcacaaaataatttatgttttagaaatacaatctaatatttttttttcttcaaatatatccttatttcacgttaataaccgtaaatgcgtgatagattaaagtattaaataaagatattttagtctaaaatacaataatattttacattcattaaatatttattaactccatttggatgacaataaaataagtattaaaaaaacatctatcgattataattaaatagaaaagtgtcattcaaccaattttacttttaaaagtgttagtattattatatagtaaacggaaagcataaccttatattagtcgaaattcgtaagagtatttaataatataataatcataatgattgatgtttgatattgatggaggaaagagggtggatattactgtatactgttgatacttgatactccaatatattcttgacacgtaattgaattcccaaagttggtgtctttctgtttacactcacaaatcacaaccaaaaataactaaacaatgaataatttcgtgcgaatcactttcttgaattgcgataaagtttaatgcaaggctgacttatatgctttgtttgcttcagagaataaaaaataataattaaagtaatgtgtttggacgataaataagaattaattttggttcataaaattatgataaacatggtgaaaaagttaaagaaactattaattacttcactattattgtgattttttaataattacgttagaagtgaatttaaaccaaacatgctattagaagtataattcaggaaattacgataagggtaagttcaaacaaaaacaagtatttctgctgttccaaaataagtttggaatatggagaaaaaaattattctaaaataagtattatattatctttttaatgtaatcttaattatttttattaatatttctaataaatactattttaatttttcatttaatatttataataaaattaattttataaaattaatatactatttcatttatcttttaatttttataaaataatctaaaataacacttattttacaagtctaattcctagactactgtaggaaaaaataaaatcaatttataacgaaagttatgattagcacgtcatttcataggctttttttaaaaactttttttgtcgatttaaaaatttatttgatcttattattaatgtttgataaataaattattttaaaagtctacaatttttttttttaacttgcaagtaatacttttttaaaatattaatgtctaacttttagttttcatattaattatttcgttgttcttaaaatatttaataatatttttttattcttttctgtatataaggtaaaacttttgcactcataagataggttttatcttttatctttttacgtaatatatgattttcttatttttatctttttattacgtacatattgataatgatagataatgagttaatttattttattattaatattttgatatttttatattacactattttaatcattatactaattacaatatttgttttattatttttgcatcatacttcctgatattactagatgataaatttattttttattttatttttgaaataattttgatattatactatttattttaatcattatattatttataatatttttctattaaattttaacttcaaaatattttaactattaaactaattaatataacaaaaacatgatgtatattgaaataacgtatacaattttaaatttattttacatttgatagaaaatattttaagatatataattacattagatgaatataaaatatgcaatataaaaaaatacactccattctatctcaattataagaaaaaataaaataaaactattctcatatttattaagaaaattagttaatttttttaaaaaaattaagaaaactagttaaatttattaagttatgtcaatcacaattaaaaataaacctttttttcttctaaactacctttattgaaacttgatatgaaacatttaagactaagatacactgatatttttttttcttatatttgagactagatagagtaataattaaaagtaattgataaataaattacaagagtttaaaattaaaaaattataaggacctcaaaatatatttttaataacaaaagtaaaatttatataaaaatacaatgcaaacatgtgtatttatgtcattttatattcaacacttacttcaataaataattttatcaaatgcttataaattaataagttaccataacaattttcactttcaagcttttaatattaacttttagttagtttttaactttcagtttttagcttttttatttttatttttatttttagctaatcttgcaaaacatagtagacatatctaatttttttttaaaatcataaaaaataaaacctcaataattattataaaaataaattaatttactatatataacaatttataattaaataataatataaaatatttacactatcaaattaaaagatgaaaaaaggaaaattttaaaatttgggaaaacaaaactagtaagattttttaatgagaataattacctaagaccaagttaaaaataaagtgagaactaatctaattgatcaagtcaaacaaaaaaaatcatttttaataagtagtaaattaatttataatttttttctatatttaaataaaaatatttcagtaagaaaattaaaaaatattaatctttttaaatatcaacaaaatatacaacaaaatgttcgttgtcttttctctctattttttttcattcttacacactacagtataacttctcttgaatgtacgcatgatccgtatccaagttttctgattagattattatatttgtatacctaatttttgtttcatatcattttcatttcgctttttttttctttttcattatattccttatccaaactattaatttttctattttgtttaattttctctttaatttttttctttcacccataactttttcctatttttatcagaacataataatcaacattaataatatttttaatctaaactaattgaagtccataataataataataataataatggaccacatggtatacgtttaatgatgatattctttttacgattgacacgtccacttgcatctttcaatgatttgacatgtaacctatcgtttttcttcactgacgttagaacccagtcagatgctgtggattacaactgaaatttagacacccaacccacttgttttcctcttctggtaattttcacattatttaattggataaatactattttaattcatattgctaacaaattatttttttgaaaaatataaaatttaaattttattttcaaatatacaaaaagtacatattaatcctgttattaacataagtctgttaactttaacattcctatatagtatatacatgacacttttcaatgaaaacgtatacatgtttcttgctatatcaatgaacagtcagggagctattttgtcagaactaatgttttccatactactcattggttaatatagaagtaagcttgaattttccgatacatataatgtcaaaatatgcctcataatctcatcaaaaatataattatgaatgaaattaatgcgaatctaatgcttagaatcggtacttgaacttgacacaacataacattttttttaatagagagggcaacacaaccattttataatacacttaaaacattaacactatgtaggatattatatataattattttttatcctttactttttttaaaaaatttttttataaacatgcatcttaaaataaaatgacaaccttttattataacacctcttaaaacgttttccttttcaatatgttacttctctgatgagatatttcttttaacatctactgaccataaaactaaataaattaactttaacatctttctatttctttcccaatcctttcttctattttttttaccaagaaatacatgactatggtctccgtatataatatatgtccatgtggaaaagcaagaaaattaaaataatggcaagtttattgtagatcgactggaaggtgcttacgaggttccttgggatcttctccttgagttgtttttcctcgagttccaaattccctcgtagcgaaatagagagattaggctctagaaactatagatttgacattaacacaattttagtttagtatttaaatacttttgattgcaatggaacatgtctgatcaacaggaaaccaaattaaactaaatttgagcatgccggcaatcagtttcaaggggatctgcttaattaagtaatataagtatgcatggttacgagataggcaatcgtaaggctttagattctcgcattaaatcatagatacagtttcgctatgtatgttatggatttccatatcttatagggatcttatcaacaattatcttttattctctctatcttattgtttgatatatagtctttttcattagctataacagtagaatagtagcctctggccaacccataaactaacatacgccgttgattcaaaccaatttttccaaatcccgttattatttaatattagatgtttgctttaatcgcttcttcagttatcatcttcgacggcattaattaataaagggtgctgctgtatatgaaataatcgagcccagtctatacatgctttggtcaagaaacaattttatgtgagactcatttctatagtctataatttaaataaaaactgatgaagttctactaatttattatatgcataatgcatgatttaatggcaccaccctgaaataaatatattctaccaataagggaagccccacttctattatcttttctttggatttttggaaactttcaataatcttttttataaaaaaagttcaaataatttaagcttggatattactagcttgttcatgcgcaaaaaaaaatgatctcagttgtattagttattaagcaactcatatttcgtcaagtaattaagatcttgaacctgaaatttgaatcaatggcatttttcttttcctctgtttttttaattgagttgaaagtcaaacaatatttattcaatttctctcaaatatctgaatgacactttttaaatgcaaatgtcattgttctttaattttcccatatatatagaaattttaatgggtcccgcgatggatattaatgaatccgtattgcatctgcattagatatctgatcctttgtaattgtattttattagtgagaagaaatcctgctctacgtgattgatttcatttgtattttttcccttctttaattactttttaatcttttttccttaattaattgaaaaatccatcatattatgagggacgtaagatgaagcgggtagaatatttacaacaattaaatacatttgaagcagatctatattatcaaatcaaacgctcaagtttataccttcaaaaccaaggaattccttgggctatagattcgaaacgatctattcatgatatcgtatccttcattgcttcagtgcttcagtttatatatatatatatgataataaataaacggacaaaatgaaataacttcattgcttcagctttttatatgatgtcctcaagtcttttagctaggttgatgaaagtgaccacactgatactgatctagcatggaagcaaggttgaatacttggaaagacacacaacatttaagttagtatgtatatcaacaacatgacaatatatggaatacaatgtttatctagtgatattaaaaatactttatttataattctcggatgcaggtgagttataataataatgccattcgagctcatcagccatctgataatcctaatagagagtgagtccttttaacaaaaatatcatgaaacacctgacgtacgtgaagtatgtgaacaagtgatgaggatactttgcttttgaacatataattataaaatgcactatgtggtgcatgtaggctttgaatagtgtattaggccttaaatttgtctcccgagtcccggccctataagggatttgagtggttagaactatcctgggtttgatcatactgaatttggcctaatagtgtaaacctcaaacaagagtccaccaaacttggcatgctgataaggaaacgtgacaaacttgtcatctaggatctttaagtagcatctgaacctctagtaaagaactcttgttgctttgacaatcgaattagttcaatcatgttaaaatttgaacctttgttaatcatggtgtagtaataaacctttgttcatctgagcatcggtgttataatgatttgagttaccttttcaattgttgggtgacagttaatgctagttgggcatgtaggacactgttattggtgtccaacccttgagttttaattcaggctggcttcactatgacgcatatttaagagttgttttattcgttatatatatatatatatatatatatatatatatatatatatgcaacaactaatgacactgatgaaaatattaataagtcccaatcttgtatttgctttgaaaaagggctatttaatttgcagtttttttgttgcactttaatctttcaaatttcaaattctttcagaatttttaattttcttcggtttccctcttttgttcacagtacttcttccattctcaagagaccaggcttgcctccaagagcgtttctcttcattattcatttgttcaacaaacgttcaagacttcgatcatcttcgtaaagtttcacattttatgatacaaagtctatcttccttgtctggcctatgtgctctccctagttcttttttcttactttatttaatttttctctattaatagtaaactcacggtatgcatatgactagatatccctagaggtgtggtaaattgaatccttggcgagtgagggaaaagtctaggggctagcttcaagtgactttgattaacttcaattttgcagtccttgaccaacatatataatcacgtttgcaaccagtcattcatatatatccttttactattaatactttaatttacatgtatgattatgtccttgtgacacttagtcctttacgaaggttgttgatcagtgagtcacgggggtggaccgtggacgcccactttatcattgtttttgcacctattccaaactcaaacgttctctagtcataagtagagatgggtgactctacattaatgtaactaccaaatgtcaacattgataatgtatgactaacttgacttttaatgatttgtaatgtacttctttaatttacgaaaggtttgtaatgtaattatgatcatgtgtaagtttttgttgcttcatattgcttatgaagacagatagaaagagacatgcatagagtgaaagtgagatgaaagaaagagttgacgtgtgttgaccattttttttttacattggattgattttgcattaaaaaaaatgaaaccaaataaagttattgttttattatttagatatttttataatgaaatgaaaaaaaaatcattccattcccttcaaattaagatggaagaaaaagaagaaataataaatgaaatggagcaaaatgcatttttatcatatttcttttaatttattttaaacaaattaaataatgaaacttaattgttgtttttattttttaattccattatatactcgtatttcacccttaatgtgaatccaaatatagtctgaattgcacttgtgaaaataagatgcagaatgataggaataattcacagttgaatagaatacctttaatacgaaactaagtaatgtgagatttcgccaggcaatagaaaataataggctcgtacgttccatccatccattgatccattcgaaaagtctactgttagtttcccctaaactactacgaatggtcgtttatgctgggcatgcacattttttgatcttttaaaatatactcttagagaagctgtccaacttcatttcatcttccacttgggagataagcataccaacttctcaggtatccattaaatattatatgaaacttgaacataaatgacgatggtacaatacaaactacaaaggttacatccacatatcttgaattgataattattgttaatgttctagttattaggagattcatatttgtaagtactacgaaggagacgcacaaggttttaaaatagtcgcagttggagtttcattattgcaagaaaatggagctgaaatgactgcaattgtaattggcatgtggtcacaatgagtaaaaagagacttaacaaatgcctttaaaatcatggatagagatataaatgtttataaatagaaaatgaagatggtgtgttgtgaaggataaataataggagagaatgaagccgacatgctatttgttaagaaagaaagaattagagtggaaaagtataagtgtccttgcatgctaaaatgtagagagaatgaatagatcgatgcgattattgcataaattggaaaagtaggtagaggtaaggaaatgagagaagttagggataaagggggagagcaaagagagtgtagtctagagtgggaacctcaaatcgagagtgaggacagagagagaattggaagatgatgagtcccagtgacagcgcttgttgcaactcgctttggcgttggagttggagttggagttggcaagctggagcagacaggcagcgacctcgtggtcttcctggctcatttgttgttgtctcctcaccacattgggcggaggattgatccctctccagtgacgctccgggtggcatctcatgtggccgaagagtgccttccaagaccagaacttcttgccgcactccgtgcagggtcgtgcctctgactctgaccataatgatgtcttccccttccaccctcctgcatcctccattaaccgcttccgcttctgcttcttccgggaacaatcagactccctcttcattcctcaattcaatcaaagccttttccaatggaaccgcatttccttatgtacctgcctcacggttactactgcaactcctctggcggtttcttcttttcaactttttttttttttttaattcttttctattccctatttccatagttcatttcaatcatttcttttaactaacttgtcatttcactattttttttaatcttttttcatttcatattatttaattatatatttttttcatctattaaggttacataaatataatattttcaatagaaatctttaaatattaattaaaatttaatatcaaaatatgtatatgtttcattagtaatacattttaattttatttatattagcaatattattatcaaaatgaacattaaattctcattatcatgtgtgtgtatggtttactaatagagacaatgtctagtacaacatgaggtggtttttttatatttaatttataagctttcaatagagatatttcgttggatgtaatgatatttatttttaaagaaaaacaactacaaagatgtgaagcttgagtgttaaaagttaattaaactaataatcatcaaagtttaaaagcgactattatatgatgttttgaaatataaataaatcaaataggttttacaaaaaagattgtattaatttgtttgaattgatttaagtataataaataaatttaaaactttctcataaaatgaattaattacttaatttaattaattgcgatttaagtaatcatagtatacaagactatatacttgagttcaattgaaactattgattatttttatgtattatatttataacatttaatttaaatattataataacttcttaaatgacttagtattataatgttcaaaaagctcataatgctctagaacgagcattattccatcatgattttgaaggtcatcatggattctccacaatcactcctaagttcttggtaagaatgaagggccaaaccttaaagttaacagtccaagattatcctcctctaagaatatacacctaggacaatgcccaacatagacaaggcacaatttttgctcgaatggaataatacctgtttcattctattttaatccaacatattctatcccattatgtttcaattcattttgtttcattctttatcatcaatctaaacatcattatctaataaaagtgtgtgaaagaagacatcactaagaaagcagggaatgtgggctgaggctcgtggtccaactgcttagactgagcccgcacggactacgattctaaaaaccaattttggaccacagaatggctcattaccctgcaggccatgcagacacaggacaaacttttggaccatttaatttgcaggccagcccgtatattcaatcgagaattacacagaatctcccataatgggacgtgtaagtgataatgattatttgctatcggatgtcatgttattcctgattgaaattgtatttgctaaataatctataaagtaataaatggaatagggagcaaaacgaatttagatccctgttcctaaaaaaatgactggggaggtgtttgtattttgaaatgaaatcatataggggtctgacatctcaaatgactgccctgagctctccagtaagcagtgcatgtttgcggtgctgggacaagattggtgccacctgaactgcagtcagtattgatgctaagtcattatatgtgggttccttgtgttcattagctgcatgcagaattgtttgcaagatttgcaagggatctccatggctgacaaccaaaactgcacatctgcaagatgtggaaccgaattatattagctgatagaatatgaataaaaagaacaaaataagaacatctcaatcaaccactggtggaagacctactaggtacctgtttgttttgccgttagaaaatcaatttttgcactttccaataatgtatggttgggattactttcgatacacattccaattacgttttaaaagttcaaaatcaatttactcaacttgaaaacaaaactacgatgcagggcttgcacacattcatgctgaaaaatcaaagaataccaaaagactttacccttgaaattctgattccatagtggccattgcagttgcaagtcgacaagcaacatccttgacactttcccctccttctggcccaagaaatggatctttttcatctatatcccaaatctcttggtactgttgaagattggaaagaagtaatcaatgagttgcaaactacagttggtgtgagaatagtgacaacgatagagtttattagaacctgaacctgactaatgttccaaacatacaagatctctatgacaaaaaaagatgcagagaaagagattttattttattaaaaattaaggtgaattggcaaaacagtaggcagcagaacaaagtgggcattgagcatgacttactttatcatgcgagaggagttcaaaagaaggaccaaaatagcgttctcgaagatcttggatgacctgcttagtgcttagtaaatgagactcgattgagggataaataaagaggcaagttgttggaagggcttaccttacagtggggtccatcaaaagggagattcaagagagttgcaacaacgttagcggtatgggttgttcttgaaaagggggagtagcaaatgcgtacgttagcaagcgggatattattggcctctagttcctgcgcagcgcagtcagggtggcgtggttaattgaaattgaaaattgagttgaggtaccttttggaatgattgtgcagcgagttgggcctgatgaacaccgtcggaggccaattggaattcggggagagtcccattctcctgccaatgcgattcaattcaataactaagaaaataatattattagattggacttgatttaatttaagagaaagcaaaccatggaggaaacgatgatgcctcgctcgttgggaatgctcttgccatgcctcagaacccagtatctgttcttcacaatccacgacatttgatttgatcccttaccctaacctaatcccctccctgtgtggcataagaattcctgttttactttataaaacaaaatgagagatcccttttatttaaaaaatatctagagaggggcatgagtgcaaattgcagagagaacctttggtttttgtttatcattagtcaattcgtctcctttcctttcttttctgagccgaggctgctgtgtgtgtgtgtgtgagagagagagagagatgggggtaagaagtaaattaagaatgtcagcgtcagtggtgcagcaggggatgaaggaaataagaaggagcgtgacgtacatgcctcgaccgggggacggaacgccgcggggggtgacgctgataccgggggacggaattgggcctctggtgactcaggcggtggagcaggtgatggaggcgatgcacgcccccatatacttcgagaagtacgaggtgcacggggacatgaggcgtgttccggaggaggtgctggattcaatacggaagaacaaggtgtgcttgaagggtggtttgaggactccggtgggtgggggtgtgagctccctcaacgttcagctcagaaaggacctcgatctctacgcttccctcgtcaattgcttcaacttgcccggcttgcccacccgccaccacaacgtcgacatcgtcgtcattcgcgagaacaccgagggtgagtactccggtctcgagcacgaggtcgttccaggcgtcgtcgagagcctcaaggttatgtccaagttctgctccgaacgtattgccaaatatgccttcgagtatgcatacttaaacaacaggaagcaagtcaccgccgtccataaagccaacatcatgaaactcgcagatggtctcttccttgaatcttgccgccaagtagcaaccaaataccctggtatcaagtacaacgagattattgtcgataattgctgcatgcaacttgtctccaaaccagagcagttcgatgttatggttagttagtttaattggttactatagattcatcttcccttccctttccaatctaaatctcttctcgtgttattatctcaggtgactcctaatctttatggaaatctagtggctaatacggcagctggaattgccggtggcactggtgtcatgcccggaggtaattgaatacaaatgcaataataatcgttcattctattgaataggaagtaaataaatggttggtgcactgcagggaacgttggggctgatcatgctgtgtttgagcaaggtgcttcggctggaaatgtcggaaaggaaaagatggtggagcagaagaaggcaaatcctgttgctctgcttctctcctccgccatgatgctcaggcatcttcagtttccttcattcgccgaccgccttgagactgctgtcaagcgtgtcatttcggagggcaactccagaactaaagatcttggtggagacagcactacacaccaagttgttgacgctgtcattgccaatctcgactagactacaccttcccatggctatgcacaatctttttcaaatatcctccgccagttttttgtaatcaaagttcattttctattgctatttttcagcagggttgaaggctcaccctataataattcggcttaattttcatgtaattatgtttgctcaaccaaagtcacttgtaacctgtccattgtttgaggtcaatttgctcaaacaaaggatgcttctctatccacataatctgtaatgtaatgttgattgaaacgaacaacactgccttccaccccctccgcttttcacgtaggaacctttttttgttggaaacatgctatcacctcaaagtgcaaggaaggagaaaagtaggaaagaattaataccgtaaaaaaccaaacactgacatgacttagaggtaatttcaattgagtttcaaattcataggctgatatatatatatatatatgatacaaattcttttctgcaggtgatcctctagtccggacaagtatgcttaaaacgaaactagaataaatgtgattagatagtgaaaattatgcaattaaggtcgtgtgtatttatctatataatatttgactaaattaaaccattttcctttacaaagtaacattgactaatttcattgagagaacccagaaagtgcttctaaaatgtcttaaattatctacacatctaaatataatatccaacggagagaatcctcttcaaaatgtcacatccagtgttgcatccatattctccatctaaagactcacgagaccacctgcaaacatgagttacaagatcaagataacaaatctcgtagatatgaatatcccatccagaatgttaagagcaatatcacataataatattaatcaacacagaaaaataaattagaaattattttcctcaatatctgctttaagtgattaagcatgccctagttcaccaataaactaacaagaagcaaaattaactcttcataaatgggcacactgccatgatcatgctgactaatattatctttgctctttctagtgacattgtcaaacaggacactaggctatcagcatcaacatacacattccgacttacaggtaacatcattttcaatcagattaaaagtcaccttgaaacttcagaaaatgagtattaaccaaggatcacagaaggtatacaacaaggccttatcccattagttaggtcagctgcatagatcaaacaaagccaatgtactcaatgagttggagcaaggtctttttgaatggtttcaccaaagatctttctttacctcccttaattgaactatgctcatttgatttacatgatcaaacgaccttagttaagtttctatcatctcttcaggtgctactcctactttatgtccactaatccaccataacattcctcttttcgcaacattagctcttgttagcccatcattgagcggcattagtcttatagttttctggtcacattgtaatcacaaatcatgcctaaagcatttctccatttcatctgaccatcttcaaccctatatgtatacccttcaaactctgcaataaatttctcatcactttgtaagatagatccaataatcttgaaccatgctttccacctccaaaacattactagcttgcttacaccttctactagcatctaatatactccatcaaggaagatttttttctagaaataaccttttactgtttggtgcacaaaatatagcagctgagtagataagcaaaaccaaggacagaaaggtaaaaataataatattattttcacaagtcgagagaaaataaaccccagcaatgatgttaactatactttactcaatcaaaaagcagagacatgataggaattgtaaaatagaaactgacctccgcaatttgtaaatctgtgtgtagaaaccaccaaggaccattctttgagagtaatctgaaaatgtagaagcacaaaggattcaaccacaaaaggggaaaaaaaatttaaaagcacaacctggcaattcaaaaagggaaccacactatctagcatcagcaaatctactgaaaggacagggtgatacactcaattactatatttctttctcttaataagcttggtggagggttagacatggtgttatccctatgttccagatggtcactttttagtcattttcttcatcatatccccctttcttctttcccccttctttgcttttactttttttttcaacctcctcgtatctatcattgggttcatctaccaccgacttcaattagtttgggttaaaggtgttgttaatgttcatgtaatgaacgctttacaatttcactagaagatttgataacccatgtagaagatgtcaactatagacacagattttcaaaaagcactttaacaattgaaacaaggttaaaaccatggcacttatacaccattccataaagaaactataatagtatagtatgatcagtcatgcatacttctatcatataaataccatcagatcaaatgaattgtcagcccaagatgtataggaaaatattctaatcaaagatggataaatagtagagggtgaaggttgaagtagccatctagtcaaatacaatgggtagagtaacctatttttattttaaaacaagatagaaacaacatgaaacatttcttcccaatacacacaaaattaatgtgccattttacctgacagcaccagctgccgcacgaagagccatgaagagaactaagcccagccatacgccctgaaggccaaaaagtggaggtgcaaataccaagaatgcagaggagactgctcccacgaacatctatgaagcaattgtcataaaagttaacctcaagaagcatatgtaccagaagagaaaaatgtgacacatttagaaaagtaaacaacttaccatggagaaagcagcatatcggaaatcagaaacaccataatggagaccatcaaaaatatatgccagtgcattaaatggttgagaagcactgacaaactagcaacaatcacagataacaatgtaattttgatgcagacacagacaaatgcaaacaaatacatacaaatcaatcagcaataccatacataccaatgccagagttctgaccacctgcaagacttcagagtcctgagtaaaaatggtggctaaagatccaaacgatgcacccagaattgcagtcaagcaaatacccattaccagtccaatctggaaaggcatgatcaggttctcaaataatttcatataacttccttatttgacatagtaaaacaactatagcttacataaaatctaagaataactaatgaatgaaaggcatcaaaggctaaaaattcaatccattaaaaaaaaaaaaaagcgcttacccttaatacaaaactagtaacttccttcacaactttgtattcatgtctggatacagaacttgcaataagggcctataaataataatatagcagtataagcaaaaaggcatatacaaacaagaagacagtaacgaagtaaaggccaagcttaaaagaatctatgaatttaaaatgttaaaaagtttcaaagtcaagcaaactgaaaattttcccaagaggttcaaacaatgcacccagaattatgtctggcttttgttggctcgacttgtttcattgcaagacagcatggtatttttactagattgaaagaaatttaggaaattataccacaagggggaaaaattaaaaagataaaatgataaagaaaaatatacaagtttttgtaatggatgattcaatacctgaccagatgcagccaatgcatctgtcagaagggaaacagccaaccacacttgcatacatatctgatgtgcagccatagctactggaccatgtcgagcagctattgatgtccccaatgtcatggttgaaagaacagcaagtgttcttccaagaaggaaaccacctgtaacagcccacagatcataactgaaacatctacaataacctaacagaaagctaaataatatacacagtaaagaaaagagaaatgtgtccatgcaattaaagttaaacatacataaattaataatctctctaaaacaataatttttctggtcccaacttgggccagcttacaaaattagtaatgtgtccattccaaacacacacttgttctcttaatgctaattcctttaaatagaaatattacaaacaacaaggggaaaaaaaatggaggtgagatcttttgcttggaaagtgttttgtaaacagtgtttgagattgcatttagcttttagttgttatcttcccttctccctactttttcaacaaagagaaaatcattttaagaggatggccaaacacactctttcatctcaggttttaacaacacataataagaaagacacaaatcctcaccagatttaatataattgccaaattgcaggtctcccatctttggaggtagtaactcagctcgcttattcagacaccagatcatcaacatggtcccaatatatctgaggtacaaaaattccatcataattagggttgaatcaagtaaagaaataaagaaaaaagtaatgcttttgaaaaggacttactgagagatgactgtggaaatggccgcaccagttacacccagccgaaagtaatacataagtaagggacataagaagacagctgaaaagttaccaatgcctgcattttgaaagaggaattagcacacacatacatacaatataatgaaaatgaaaatgatttttaaatttaatcaatctttgaaagaaagtaaaagagggcaatccctagtgtaatgttaaaattatgccttggtgacagctggtcatgggctcaaatccgaaagcaatctctttccatatgcaatgggaagactgagtacaattaaccttcccccatacctttgggaaatgaggagcactgtggtatgttagtttttttatttttaaaaagaaagtaaaacagcaagaacatttatgatatcaaaatctaaaattatttttcaagattataaatcacaagtagagggcgagtcctggcacagcgataaagttgtgccttggtgacttgttgatcatcgatttgaatctggaaacagcatctttgcatatgcaagggtaagactgcgtacaatatccctcccctttaccttcgcatagcaaggagcctcttggcaatgggatatgtaatttagttataagtcacaagtattccaatcaactaaaaatatcaattccctctcactcttcagcaaacatgctatgataattttgttcattccttagagttgcatgcgagctagttaataataacaataatgtattcatgaattgcgagtaaaggtattagagtacatgcagaaaataaaatagaaaaggtattgaaaaggagaaattaagaaagaaagcaaacacttgccgagacatataacaggagtttttgtatccttaaaaccgcggaaaatgccttgaagagccaaagaaagtacaaccgcaggagcgccaacagctcttaaagagagaaagtgtcgtgcgggaacatatgttggattttgctgttgaaaaaggagaagacaaatgatatactcggaagaggatacaagaaataaaacgcataaaggagagggcgaaaacatactgtaggaacaccaattaaatggagaaaagctccagctcccaggtataaagctaaagcctcaaaaaagccaagggagagtgccaatagcaaagcagtggagacagaggagagttgttgttttgttttggcatctgcagtggaggaagccttggcaatgtcctcggcaacaaaggaagtagcaacacttagaagggggatattaaaaagcttagaaatgatgttaaagatggatatggaaacgccggcagaagccaattcaacagtgccaagtcgaccaatgtaggcggtttccatcaactgtgctaaggggtcaattgcctgactggcaagggcggggagagtaagagatataagctctcgtttgacatccacagaagcagaatctgaatggtgttggtcctgagaagtgaaggaagagggtttagcgccaagtgctatgaacggagcggagaggctggggctttggcgcaggaagtggtggtggtggtggtggtggccataaccgtaactgatatggttgcgcttgcgcaggaagggtcttctggggaaggctccatgatattgatattgaagttggtattgagaggtggtgaaatggatagcctccatgagcatcaccgcctgcactgcaagaaagaaaaaagttcaataatccatcaacatcgaaataaatatcaaataattaggcagactcgactccacctgcagcccacagaacgtatcgtcgccaactaaccttttcctctccctctgcaatacaaatagatagctgtctccgcttcgctcacgttcagctctttctagatgaaattttaaagcactatggattaaattattcaggtaagggatggtcataaaataaataaacaaaaattaatattttgactattcatttggaaattactagttaaatgttattgatttgactaacttacaagttaatccgactaaaataaacttataaatatttttagcttatttttagaaattagaatatatatatatatatataattataaccaaataatcaaatatatcgttttattttatattgttttatatttattgactaggttataatttttagcaattctaaccattgaaagggagggagtatgcagtgattttagatgcggagcctccaaaccagattaaacagatgttggccctttaatgttttaggagtttcttccacatttagttttaatgtaattttctttttctgggtttaggctccgctaattattaaaaaaaacactttctaatcaatcagattaacttatatatcaatatcaaaagtataaaataattttacattatcatctgataaaataataaaatatatgataaatttattaaattttataaaattatcttaaaaataaatattttttatctagcttcaagtgaacattagaaaccaaaaatagtaattcaatttttttaggacagaaatcaaaatcaaaatacttttcagagatcaaaattaacatttttttaagacacagaatatatttgtattgcaaaaagagggattaaagctgtaaagacattgtaaaattagacccaaggacaacagggggattagtacagaagaagaaaatgcctggttttactccccttctatacaaaacccattgccacgctgaggattttatccggcaaagctaacattcattcatgttacttgggatcaagaataatgatttcaatgaaaaataaaaaaaccatttttcttttaaaaaaatcaaaatcaaaaacttgttcatttaaaaaaaatgtcacttttaatttattacatttttcttttttaaaaaaacaaaatcaaaacttgttcatttaaaaaaaaataatgtcacttttaatttattacatttcacagttatttcattctaaaacattaagttttaaaattttcaaaatatatcatattttaaattttttgttagaaatatttctgttttgttaatttttaaattttaaaatgatttaatgtcacttttaatctattatattctgacagttgtttcgctttggtacattatattttaaaaattttattatgattatttatgtttttaaaatgtgttgttttgatcattttttggtacattatttttgttagaagcgttatggtccaatattttaaattttataatagttaagttagcatagtggtaactaaaaatcatcattattttttatatttaaaaattaaaaatcactcaataaatgaagaaaatatgaatttgaaatcacaaacaacaacaacattcactctattattattattattattattattatattattattattattattattattattatcttcattcaatttaatcatttaataatgataataatttcattcactaatcattctaaattacaatgggtaagggtcccttctcctttcgcctatcgcccctaacccaaaaagatcgttgccccgcccccgcttatgtcttcgccgcaacctccctacgtagccataattgttgcctcacctaacaacaacaattgtctcatcgccgcactgacaacaacgcattgacgaaagcgaagaaaaagaccaacaatgcctcatagtggatgaggtttgaccgatcggaccagtcataatcatcttccaatgaaatgcactatttaaccgctctttgtgctactcgtttttgtctttcccagttgtaaatgttgaatgggaaattctatatttattcggtctaatcgtgcacctaatcgtgcacgacagtggagatcttgctcgcaaaccttacaaagagtcacattatgacttcctcgttcatatctgaattaattggcgagataaggtcatatttttgtctttcgttgaagacactttttgctctgatctcccctgcctttgtttccaatagcatagctgatgaaatgttttgattttcctgtaaagagtataagaattttttgtggttctagggagattatgtgttgacgtcgttcaatctgtgtgatgccgaatattttaccttttcaaatttggaagaggttggaggagttgaaattttttagttgtttagttatttttaaataaaataaagataatgactatttttagtcgctactatgtaaagttaattattttaaaagacttaatgtctcttttggtatattatgttttgcatttttttcacttcgatacattaagttttaaaagttttattttggtcctttatattttttaactatatcattttggtctttttttaaaattaaaagttaacataacactaacgtcgaaaaattgaaaaaaaaaaaaaagagaccaaaaagatacatttaaaaaatgagcataatgaaatttttaaaacttaatgtataaaaaaaaacaactttaaaacataatggaaaaaatgattaagtctttaaaaagcctgaaatgtttctttcatacattattaatttgataatgcaccctttcaaaataaatttgataattcacccattaactaattgaaatattaaagtatgattctagatactctcaaacattaccttatcttagatcaatattaaaatgaaaaatgctactcagactctcctaaactctctttttaacactactaaaataatatcttcatcaacatacaataaatccgggaaagcctcaaggctccaatagattaagaagaactaataacttgagtaaaattttgtaagaccaatttgatcattttcacatttcactcgtcactatttccatcaattacatctattttgatagatagcttgtgcttcaactcctctctacatttacgaataaactttctccaattttggtttcgtaaccgtaacatagaggaatgaaacgcgagagcgagatcatgcaccacatgaaacacacgtgaagagtagtaaagagcaaccaaattttttgatgggattgcataaataagtactaataaagttaaggtgcagaaagaagaatttgtgccttaaatgttcatcaatcaatgtatgtcgttgttacttgttggcagtgcccacgtatccattaagaaatcacttttctctttccctttgattttcaatcgtaatattacacaaggaaataacagttatcagaaaattagaattcttagtacatgtttaagaatttttttttaaataattatttttcaaaagttattttagaaacatggttaaaaaaaataactttttctttgaaataaactcaagtaaaagcataattttaaaaatttattagttttatctacctgtttattttagtaaaatattttattcaattgtaaatacaatcaataaaaatggcctgtagaaggaacttgtgttaatataatcggagtaaaaaaataaataattagaatgagatacatacatgttatatgtttttcacatcccaatactcaacaaacacactgtttctaatcacctcttattgataatgatcttaaaactaatttatgtaatgtaaatagtgaaagaaaacaaagtggtaagtcgtaatgaaagctataacagagttgtgagtaagaatttgctccaacccaaaagcagaatatatataacagtagtaagtacagcttgaatataacagactttgagttccatatataggtagagaatccgctggttaattagttagagtcaagcatccaagaaacttgccatgcactccatatttagagtttagagatggaattgattgtaaacatttgagtcaaaatcaaacttggacagcgaaaccaagtactcaacgttaaatacaagattaacgcgagcttaattgaaattttggtttggtgagaaagtaaaatttacgaggggattagttggagttggaacttagaagttagatgactcattgacacgattgggttaattagatacgtatatattgttgtatatgcattgtatttgatcgatcattcaattccgcgcacaggtatatcgattttacgtgcggttgcgttcgtttctgttgaaaggtcgtcgtctcttctccaccttcttcaaagaaaaggtgacaaaatggaaaatgcgagaaacggtgtcgttgctgcgaatgcgcttcctcttcttccatgcaatcaatagcattaagcaacgcaatattgatcgaattaatgaaattcggcctaaggtacgtaacgacagcaacagcaatgaagagaaagaagcatcacactgagaaatccagaataatcggactcctggttgtgagtttccttcgaagtcggctcctccaccgcactctcatcatcgccatctccgcatcccttcttctgctcttcgccctattctctctgttcgctccgtccccgctaaatgaaatcaatcttcagactcagaacaatgaccaagttagatcacgattcgaggttccggtaagctattaagtagtaactaaaacgcaattgtcactattctgcattttattttgcttaatctatttgtgttggttggactttgaaggcgggtggaggtagatgcaggcgtgatttatggcgttcaatgcactcacgcctcttctatggctgcagtaatgccggtgtcaattttgcaagtaaagctaatcccaatcatctcatctcgcaaccaatttatgaatttaatttcggactttaaattgaaccaaattgtaagccgtgtgttcattcgttttttattggacgtgcaatttgattgcgtaagtacttgtttcttgcacttgcagatgctaatgtcaaaacgaatccagatcgatacttgctgattgccaccagtggaggtttaaatcaacagagaacaggggtaagcttcttcatcaactaataactatctattatcagctcatatgcaatacctatggtttcaaggaggtaaccaaacaatattggaagatttacctagtctttctgtatgtaaccaacatggatggttcttttctttctttatctgaaatatgtcatatgctattgctctaaattcaattgatatgatatgagagttttgtctggcggggctatcagacaccaatataatatgtgatttagggatacaaatttaagtgacatgaagaaggctaatttctgtggctggattattggtgcagataattgatgctgtggtggctgcatatcttttgaatgctactcttgttgttccagagttggatcatacatctttctggaaagacaccaggtctgtctttgccttgtaaatcatgtatgatatttttattggaagcaatattcatggtctcttaatttgtgtgctatttttttgcagcaacttttctgaactatttgatacagactggtttataacatttctccggaatgacgtgagaattgtaaaagagcttccggatatgagagggaacttcgtggctccatatacggtgcgtgttccaaggaaatgcacccccaagtgctatgaggatcgtgttttacccgtgctggtcaggaagcgtgtaagtcttcacatcctcaaaattatttgcctgcattccaccattaaaatctggacttttcctcccctgttttgagcctagatgctgcatgcctttctgttttttttttggtttattttatctatttcttttatagaacttaatcttgccaaatttataactccttaaatgcactcagtagtataaatatttcaaattgctagttttgggtaattttttctcttacgaactgaaatcttttgttattttttggcatataaatagttcaggggggaaaatattcctattcttttccattctgttgtatatgaatatcaaagcctcaacgcattttttttattatcaactatagtgcacgtttggttatatattaatattaacaactaatttccttatttttataaaaaaaaaaatcaggaaggtgaaaataaatatttgtttcttaaaataatctaattcaaacatgcggactttactagtgaaagttgcgttaattttacggttgagcaaaaatagttaattttactaacaagtatcttgtactttctatagattatttttaaatatattaaaatttaaatttatttaaaattataaatatacataatttattaaaaatattataattaaaatttaaaagaatagaagttaagaatagagtgtactaaaagattaatgcacttttaagtcggagttttctaaatgaatatgtatgaatgaatttacttgaaaatatatgacatttgatatgaataatgtgagtagagcttttaatcataaaaaatcgataatcgatttttttagtagaacatttgatatttgattaaacatataaataaggaacaataaactaaatgaagaatttatggaacattgattaatcaaaattgaaatttatttaagcaataatgacggttgactctcaaggaaaatacaataaggaaattatcttaagtagtgactggtgagtctgtaaaaaaagtagtgacacgtagtagtgtcttggaaatattatttaaaaaacaaaaaatcttcgaagctatcatatactgtgacaattgctaatcttcaactattgtaataagtacgttatggtggtgttcttgattcgatggatgatacttgaattccttgatgcatgcaggctgttcggttaactaagtttgattatagacttgctaatatgttggatgaagatcttcaaaggctgaggtgcagggttaattaccatgctctcaaatttacggattccattcaggggatgggtaaattgttggttgagcggatgaaaatgaaaggcaagcatttcattgctctacatttgaggtaattaagctttaataattatagccaagctttatttctggttcatttagttcctcagcaaagaatgcaatatgcagcatgatatcaacgtcagaatttcatcagcttctttaagttataaaattaactcgcattttgtaattgagacgctaagttcttttcatttttcatatagaagttcaatgtgattcaaactgatgttttatcacataggtttgaaccggatatgcttgcattctctggttgctattatggcgggggagaaaaagaaaaaaaagaacttggtgaaattaggaaaagatggaaaaatttacatgtaaggttttttttattaattacatgtaaaggttttagtagcatctaagaaatgagctccacatgtacgaaaattgattgatatattctctcttatttggaaatgggagacaggcaagtaatcctgagaaagttcgaagacatggaagatgcccacttaccccagaggaagttggtcttatgctaagagcactaggttttggaagtgaagttaacttgtacgtggcatctggtgaaatatatggaggccaggaaacgttagcccccctgaaggctcttttcccaaactttcattcaaaggagaccatagctaccaaggaggagttggcgccatttgtgtcattttcttctcgcatggctgcactagacttcatagtttgtgacgagagtgatgtatttgtaacaaacaacaacggtaacatggccaaaattttagcaggaagaaggaggtacttgggtcataaagccaccatcaggccaaatgcaaagaagttgaacctgttattcatgaacagaaataataggacgtgggaggaatttgcctctcgagtacgaacattccaggtaggctttatgggagaaccaaatgagttgagacccgggagtggtgagtttaccgagaacccatcagcttgcatatgtaaaaactctggtggtgggggaatttcctacccccaaaatcacaacagtattaccgagtttgaagagcagcaggagtggtctgaggtagcagataataagctcaatgccaatggaactaaaattgattcactccctcttctaatgaccacggaccaattagctgaagtgcaagaattcttctccgattaactctgttatctccccaatgatttcatggaccgacggtattgaatttgtacatatatattcagcttgggaaaaaatgtagactgtaagtagcaattgtatagagtttgaagcttctagaaggaagactcgttaaggcgttcgtttgctttgatcatagtgttaactgttcaggatagcagaatcgtcagtgttccataccattttagatatttttaaagatttagttgtacatgtccaaaaaatgaaatttacaattcaaaaactcttttttgtctttaacttgttttttcttgtgtggctttggtgcctcgcacccggagaaaacttgagttttattgtgtgtggttttctaaacgcacttggagaaaactaccggactatccacccttctggatttgaattgactctgtggcccagtacttgcatgaaccattcgtcttgctttgcctttctcatgggctttatcatagccttttattataccttcacttgattagtaaatttgtcttttttttcgattggtttaattaaggagcactttgaaaagccatatttacggcaatttctactttgacgagaatgtaaatttttttactaacaatatatgaaaattagactcttatttttataccatcattttaattaaaaatacatttcccttgaaaaaatatgttggtgatgtaaataaacaaaaattcaagattgtaagactcaaaaacatgttaaattgttttaaaaaaagaaaaaaaaaagaaagcaagaaaaaacaattaaaatctttttaattgtttttaaaaaattgatattaaattactgatatatccttattacaagtgaagagatgatggattcttttttccaaagatttacggtataagttgctaatgtactcatacttaaatacttagtgtgagtgcattagcaaactcctatacatatgtgataatttttaaatattaaaaatatttaatgtttttcatttaaccaaataaaattttattgtaaaaaattaaaaatattcttttaaaaaagctgaacgaaaaaatttatcctttacatgatagagaatctcaaacaaacaaagcattaatgtttaccgcagccacatattatggtattgatcccatttatttaaacttattttttaccagagtgtttttattgataaaaaagttttttttttgctttttttaaaataaattatatatacttcttaaaaaattattttttttaaatttaaacaattgacttattattaagtaattattgctatttttgtgctatttttgtgttctttttggtaataagaaaaatgttatgcataatcatccgttgttagtggtgtaattttttttattgacaaatgttattggttaattttattaaaacgttaatgaaaaagatttgtctatcatggcgtggcatttcatagctgaaagaatgccttcttacagtttaatctgtgaactgaaaaaaatacatttcttcttctttcaccatgttgtataattaaaccaacaaatagtttcctacttttctcccactaattatttttcctaggagactttgtatgagtgtttggctctacttaataaccactaccaaaaactgacaccaatcatgaaacccatcaatggacaatgacaatcctttgaaaggtgacgacaagtcctttcaagttgggaccattagcgtaactatgaagcgctttggtgttgccatttgcaatccaatcttattggctccaacaccgcgaaattatcaaaaggattaattattttttaaatttatcaaataagaataaattttaaattaatactagggaaaaactataacatctttaatagtataccttaaacaaaatcttgaattcaagattttctctatatctccaattaaaagaggtgaagagatctctaacacatgaagaattaattcttataaaataactcttacaatattcacattgtttaaaaaagaataagtttttccttgttctttctctctccttaaaatctcaaaataagatctatcaaataaaaaattagaaatatattaaaagatcttcaatcctatatagttcgatgggaactatagaaaagtgatcgattctaatttgagatataccattaaaaatgttcttactacttctaaaatcaaaatcataaattaattcaaaatttttatttttctattttttactaaaacataaaaaataacaacttctgatttttttaattaagactttaaagtcataaatattttaaattttttaaataacatttagaagtcacatatatatttacgacttcaaaatcatacttttttaaaaaataattattaataatttttaattatttttaatttttaatttatagttcaatatttttaatcaatatatttaatatttttgttactaatattaacaaataattttaacttaaaatttatcacataatattaaattgtttttaaatttttaaattaatttttaactttatcattaaataaattaataatttcatacagtattattaaataattttatttgataaaattattttaatattaacaatagaaaatattttaataataaaaataattgttaaaataaaaataacataatacattaatataaaatgaacaatacaaactaaatacaagcataaaattaaaaagtacaaacaatattagtcatcaacttacttgtatagatacttattataattatgtctttgagttctaaacaatgagtttttcttaggcttatttgaaattgatttgttcatcttattatatatatgattaatgattgacattcacaatgtgtctagtcgctttgaatgatcaaatataaaatataaacttaaatattgaggtaatttaaatttatctttacttccactttaatattttttatttaaatttaactctttcgtttacattattttttaaatttataaaataaataataatccttaaaattagtaaaaaatataaaaaatattaaaacaaatagtatataaaaatatagaaaatattaaataaaaaataatatataaaaatatagaaaatattaaataaaataatatacagatatagaaaaaggtattacttgaagttgtaaataaatatgtttatgacttctaaatagtatttaaaaaattaaaatatttactacttcaaaattgtaattaaaaaaattaaaagtcatttatttttttatgatttcaataataaaaaaattgtgaattaatttatgaatttggttttaaaaattgtagaataccatgcaacttacccctttgtgaatattaatttaaaatttatcctcatttaataaattccataaataattgcccctttgttaatttcggcccccagcccccaaactcccttacaatcaaattgtactcagtagttacattaaattatgaattaacacatattctaataaataaagtgcatttatgattaatagttggcttttttatattataaaaaaattatattactttgtttaacaaaaaatggttaagttttttatttaaaaaagttgaaaattactatattcgtctattgaattaaaagtgtttaacaaaattatttattgtaactaattaactataaaataacatgaatactatatatgatattttaagtttatgaacaaagatatagtagtaaattttgtaagattaattttttattaaaaattaaaataaagaatgtaaataatttaatttttttaaaaatgcaatactaaaatgggcggtggtggtgaggattcgtgaaaaaatttagataaaaacaagtattataaagatgaaaattaaggtaaataaagaaggttttaaaatattaaagacaaaatgaaaataataaaaaaaatgaactcaaagtcttaacttttaaaaacataataaaataataaaataagttaatttattaaatatttttattttgataaaataaattataaagtaattaaattaattggttaaaaaaatagtcatagtcatatttatatatatgtatggcttttgtttttggtacagtatgtatggcttgtttggtatagaagatggaaataagtaaatgtgtcagcagttcatttagtaaatatgactatgactgcatgcatggtggggactgagtgggtctgcattgcatcacatattcacatattcacatgtgctctgcacgtgagtgtctgaacccgtacgtacccttctttttcctctctgccctcggctattagtatcacttataaaacacaatgcaatgggtttatttaaagatttaaattcaacatgaattaaaaaattgaacagtgtaactaaaacttttatagtaatagaaaagacgggggattcgtataaagtgaatcacatgcacatatacttgtaccaaacaaggccaaacataaaaaacatgaaaattcatgagaaagcctttgtgggggccattgcaattcatgagagcaagagcaataacacatttgaaatttggggacgctccaagggaccaaggctctcctaactttcccacattcctatgacaacattatgattaaaatccttgccccatcagctcagtggaaagaaaacaagttcctcctctctctgctttcatgaccctaaaagattggtaggcctatatgcaggtgaaaccacattttaggatttttttttaaacaattattgaataaaaataaattttaaattaaaatttagaaagagaaaaatcataaaatatctcactatttttgacttgaaagtaataaattattttataatttttttattgaaatcgtaaaaagatttatgattttttaatttttttaaaaattttgaagccgtaaattatatactaaaattgtaaataaatttatttatattaatattttatattttagtatattatattttttatatttttatttaatatattttctataaatgaaacactaataaaataaagttgtgaatatatgtgcgacgttaaagtcgaactagttggaatatactatataattagaagaaaaaaaatccttaaaattaggaaaaaaatatagaaaatattaaataaaataatattaaaagatataaaaatattaaataaaaatatataaaatacaaaaataaaaatattaatttaaagttggaaataatttactaatttaaggtcgtactcaaaaaaacttaaaacatcataaatttttttttaccacttttttcgtagaaaaaaaataaaagttgaaaaatgatttacaattctaagctcagaagtcatgaatatcatactacttactcctttctcgatatttatttaagtttatctctatttcataattaaaaaaaaaaaaaaaaaataccctgaaggttcgtttcgcccttatccggatattctccacctgatcccatcctctcttttacttctattttttctaaaaagaaagtgtccaccttcgttttcacctccttaattaacttttatgtaaaataatttaataacataaattacatttggcttgctagttttcttcttgacctataatacatggacatcctttaattataaatacctatataacatcttttgtttcttttcatttctttttgcagtattgcattttttatcatctttatattttttcgtcaaaaatgaatctaggatcccagaggtcagttggaacaatctatttaaaaaatgaatttaatacataaaaataaggtagtaagttcaaacatataaaaataaaaggtgtccgatattaaattttaagataaatatttatgattttattaaaataaaggggtatatatatttgtttaccctcacatgacaataagtgagagggttcaaacatataaaattaggtgatgcaatatgaaaaatataatattttaaactaaatacatgtgactttattaaaataagggggtatatttatctagcttcaaataagagtcggtttgtcgttgtttacaatgaaattgttttttctgttgtattttttcatctcaaatatatacaataaaaatacaattttatcgtctatttcgaaaacagatttatatttctattattgtttgacaggacataacttttgactcatgttcaattttagcttatagtatgtctatttcatgtaacttttcgagatgaatgtatggcaagtacccaaattctaatatatttttttttttaagaaaccttccttctatgaaaaaatggacttgaaagatttaggatttggagtttggagtgtaggcatggcagcgggacccgaacccgtaggtacccgcccaaatccgccccgattttaatgggaaaaaatcgattttttctgatttgggttcgggttcaggtttttcctggtagccaaaagcgggggcggggcgggggcgggtatggggttactgatacccgccccgccccgcccccgcccccgccccgtaataaataatattaaaaataataataataataataaaaatattattttctaattttatttaattgaattgactgattttgttttgtaattttaaaattatgatatcatattttaaatgtgggtttgttattattatttttttgttacataattaacttttttatccgattttttaataaaaaaattattttattttttaaattttaattaaatagcgggggcggggcgaggcggggaaaactcgacccccagcgggggcggggatggggatggggtttaaaattcgacggggaacgggggcgggggcggggagctggtttgggggtgggggacgggtatgccccgccccgttgccatgcctattggagtgtaacgaaaaaagaacggagaagggagtgggggtgttgtgagaggatggtgatggaaataagggaaaggttttgggtgtaggaaagggaggagggtaacaaagacaatttacattttcttggatgagaatatagcttattttgagagactataaatttgagagacaacagcttattttcttgagtcttgacctataaattacattaataatcaacaccgtcttacttaccataaattacatttgtcttgctagttttcttcttgatgtataatatatatgacaccttttaattattaatacgtcttaaatctcactttaaataaagatgaatatattaaatctcgtgtaagtgattgacccatatacataatattttatcttatattaatatatacaatgtcgaatgtctacccaaaaaaattatacaatgtcgaataattaactcatactcgtattatgttctcttaaaaaaaatgaagcaaactaatttttttcaaaaattaaaattaacttatatacctcattttttataagttggacgagtttttataaattttttattcattttatctttttattttatttttttaataagtgcttactgaataattttacccaaaaagacttttttaagatgatttttgattgattgtgggtgtaaaaactaaaactttataataagtatttggacaaaattttaaaagaaaaatagaacaaaaggtagggcattcattttcttggtgaataatgaaaaattgaaggaaaaaaaaccggagtgctgcaataattgtctcaacagggatttgagtactggcgaagcttatgatggagtggttaatgcaagcaaaggcatccaatcaacaactcaataatgataaaataaattattggattgggcaatattgattattactgtatgactctggtagcagtaatttgatttcacatttgcatagatatatgattttcgactgtatttatattctccctcgcgaaaatacaatattgtatgtcaaacaaaagttacagaaccgactcaattcaaatacggcggctagtccacaaggatttgcaatattgtaatctggatacatgacatatacgacagaataattatagatcgaatattaactacggattacggaaattccctaagacgaagatgcatgattgttattttctctttgcatgctttttgtggatgctggtagaaactagcatgcatgtagaatttagaaacgtaaattaaacagaagaacattgtgaaaaaaaagaagtgactgatgagacaacgacgtggtattatggcattcaattgttgtttgtttggtgcatacaacacattaccaatcatggcttgggggacccccccaccacacacacttccaaatcacgttaccacccgcaatcaatataatattggtgccgagatttatatttgagtaggaaaatgttgtctctatataacacaatagtctctcacacacacacgaataatatatatatatatatatatatatatatatatatatatatatatattttaattcttgagaaatagttcattttattgtttaaaaatgcctttagaccgttagcattttaaaaaatatatgatagagtttactgcctggtcatcatggtcataatccattggtgattaatatctctccaatattttattctcatcctatgcacaacactataacaactgaaatcagaatcaatagtttgatcaggtgacctgttcaaatgattatatgaaatttgtggtgtatttaagcatgaggatcccttgtgggtctatatataaagatcaaaagtctttctgttaacatggaagccaaacatgtatttcgttgtcgtgaaatggtggaaagcatgttggcagcaatggataaactcttaaggcctaacaatgaaaggcatattggtagctacaatggatatcagatactctggatgaaaaaatgtttttgtttgaaaaaaaattattatataaaatagactcacacttaaggaaaagaatattgaagctaagatataaaggtgaaatctcataatagataataattaataagttaagcaatatataactaaaaaaatcactaattaatttaatatattaagattttgggttgaaagtgatgttttacttgtatgtgtatttgtgatctaaatcacaaattaatctaatgtcttaagattttgggttaaaagtgatgttttacttatatgtgtattgtgatctactgttgaaaattttctcagagtttttgagtattttatcttccaaaatttcacaacaaattatttttttaattaattattttcacgtttttatgctaaaaattttcttcaaatatcaactgtttgtactgttaatttttttttaaaaaatattatattaaattaccagatatattttagagtaaactgttaagtgtatattctctttaaatatttcttacacaatttatttttgtcaacacaatttcttcaaatttgtatgtgactaaattcacaacccgtagaacaagataatgaggatatgaaggagcagatataaagtgtgtaagtgcgagtgagccaaatggcaatgacacctcacacctattcgctgattggtacagatagggtatcttctcaatcttattggctttcataggtatttcatgtttgttctcccactccattcagtaagtgcccttgacaggatttcttgttggacatctatcttttcaaagcttcatgattcttctaataataataataatacatgggaagctgaccatttggattgttactttaattttattaaaacaaaaagagctttatgagttaattattagtattacacatcatatgaaagaaagaaagaggcatcaaaattgagagaaattaaatagaattgaaatgatataataacaatataaaactaattttttattagtataaacatttttaataaaaattaaaatagtaaaataaatataaatataggctaaattatgttttaagtttatgataaattaatatattttttttgagtctctaataaaaaaattattatattatatttctaatatattaaaattttattttaggttgttgttaattaagtgatgatgcattatttttaaaattttaaattctgatttctagtagctaaaaaattatcactatttattttaaaatttaaatttataattttggatagctttaaaatcattagaattaagtaatgcaaaaaaaaaattcctcaaatcccaatcttcatcccataataaataaacgaataacaaattagataaaaaaaaaaaaaaagagttatggttatcagatagagagaagccatatctcagattaaaaaaacaaactcagaattaataacaaataacattcaaaccaagaagtcaagattcaacccaaatcaaagtggacaagttagatagtcagatagaggaatcaaaaatcacacctttacgattaaaataaaaattgattccactgtcagtgacaaaacgccaccatatctgcggatccatttctcactgactaaacgccaaggtaaatccgtttctcagtgggtttttttacgtagcaggaaacaagatttgtttttttttttttcattaattaattctagcggttttaaaaccaccgaaaatttgtcgaaaattataatttaatttttttaacttactcgatatttaactaacagtagagacttaaaacaaaatttctaatatattgtatatctaacttaaaaaatatattagaaattcaaaataaaatttactaatttattagtaactaaaacatattttaatcatatatatatataataataacatgatatactgtattagacataattttattcataaaaaactaatataaattatgaatgtaatattaaatatcagaataatatattgtatatatttttaatgtaatttaatatatatatatatatattaataattaaatttaaattaataaatatattaaaataaatgctcctgacattttccatttacttggtgtttggaaagatccatggattcggtctaatgatagttcaaatgctccatcagttcctctcatgggtctcgaaaatatgaaagtaagtgagttattggatcccactttgaactcttgtaatgttgcacttattcataatgttttttcccaaaatgacgctgaaaatatcttgtctatgcctttacgtttaataaacactcctgctgataagattatttgaaagcttagtcaagatggggctttttctcttagatcttcgaatttttgtatcatggaaatttttttggataacaatcatctctgtgaaagtggtaattggatggctatttggaatttgaatatatccttgcaaaaatgaaagattttatttggagaatagctagaggatgtttcccaaccagccaaccaggcaacgattatctactatggtattgaaaatgattggcattctttcctaggctgcactcatattcaacatgtgtggatggaagcttctttgtggcatattcttcaacatgcttttgatactccggaagatatgcgtaatttcatatttcacatcccggaaaaattcaataacagccaaaagtggagcaaattgttactgtactttggtgcttatggcggagaagaaagggagaagctttaggatggagctaataaacctgctggattgtctctgcagcaagcttttcagcagcttcaagaatggaacacacaccacaaacggcgaaatatacttccacctcaatctgaaatatttgaagaataatatggatgttattttttttaatgaagacaacaagtttggtgttgctgctgcagcaacttcttggttccaaggtcagccaaactccacaagaggctgaatctatggctctcctatttgctatcaactggaaaatagatcagcaactgggtaacattatcatagagacagattgccaggttattcctgatgctttcaaagcaaaaccatttcatgatctcgaagtgggttgcattttaagaatctgtgataaaaaattttatgaaattcataactgtagtatacagtttgttagtaggcaaaccaatcagatctctcataggttggctagagcatcaagatcttatgtttgtctacaaatgtttgatttcagtccttcttgttttcactctttacttattcataacttaatataagtttgcttcattaaaaaaaccatttttcgtttactagtgtatttataaatgactttgtgtgtttttattttattttattttttataagcgtgaactaatattttaacacgtgtaatgcacaataaacatgtttatattatataattaaattttataataaataaattcttttgaaaatttatattatattttaattaaattttataataaataaatatttttaaacatgtagattgcatttaaaaattatagtgaactaatattaaatttaaatgtagtgtattttaatgaaagtgttctaaacgaattgttacataaatatactatagagtaatgatatacatacattcatctattttaaatattttatcaatattttttattttttttatctttcttctaatcatatcaaaaaatttattatacatataatttttctctttttcaactttctctctaaatataagatagtgtcatgagtgttaaccaaaaatgtttcatatgctataagagattataccgaaacttaattacttcgtgttgtgttagttgggttctccttcatctttatgtgctaagtaaaaggatgtgtatttgcatagattctgatgccaaatcaaaatttagtagagtaacaatactgatatatgaattatttatatctatttgaggttgtcatgtagtatttgtagagaatatagacattatgttgtgtgattttgagcttgtcgtcacacatctaatgtaaaaaatccgttgcaaaatacatagttttgtatgtaaggcttatgtttacagaggccgcatgattgacaatcgtggctttgtgatttaaaggagtaatacttaggcgacgattattcttaaaaattgtcatacaagttgtgtagctggtcagtgcaagaggttgattcagttaagtaatcttctgctgagcaaaattgtttgacttttttttttttttttttattgaagttgtgaccttattacacttttagaacaagtggtaatacaatattaattatagtattaagacttgaatattccaacaacaaacaatactcaggaaaagtgtggcaacagaggagggggagtttggagaacttttttgcttatgggagaaaaagttattcataacgttaattaattaggcgaacaaatgtggaatcaggtttaatatataagaaatttaagtcattgaaagtcaaaagaaaaagagttggcatgtttaacataaaataagaaatatcacattatattatcaatgagagcttcgcgatatgttatcttaagcaaatcgaaggaaaacaatcaaagaaaataaccgtatggaagacctttaattttaatatgttggtatatataagcatagaaagaatcctaatgaaataaaaatacaaaaaatgcttcctatattagttgtaattaccttaattaactcaaattaaattatattggacaatcaattaattgtccttttatatttgtttaaaatattaaaataaactgtgatgaatttaaagcatttaaaattataaataaatatatagtacataatattcagtaaatatatatctaaaataaattaatgttgatttaaatttttgtattgaacaatcaattaaaattgtggatgtgtatgtcttataatagtaaaatatacctgtgtgaattgatttaaattttactatataaattttatttgtacgaatcaattaaaattatccttaatcattattactaatagaatcatttaaattttacacgtatatttttataatagaacaaatttctatatttttacatttttactcttattaacaaaaaatatatcatatcaatttaggcagttcttatatttactatataaaatttgaaaaaatagaataaatataaaattagaatatttcaatttacaagattgatcctcatatattatatttaatttagaattctataagtaataaaataatataaaatctacttaattaaattattttgtgtgaatgaatatgacgtgtcatgtgatatcaactcataaaataaaatgaaataaaaatatcatatcaatttacacaatttttatatttactctataaaattttaaaaaataaaataaatataaaatctgaatattccattttatactattggtttttatgtattataactaatttaagattctacaattgatttaatggatttaagattttattggaaatagaataatataaaatttaattgaattatttggtgcgactgaatattgggtgacacgtgatattaattcattatcactaaactaaaaaaaattatcgagataaatgagccctttaaataatttttgacctttcaaaggattaattcttgaaaaaagaatattctacatatctgactttaacatcaacaaaaaaatagaagcaattcattccatgatacgtttgccgtaaacacatccatatgtggacaattctttggtattttattagaaacagatgattgagcgggatagtttcattagtttctgcgtctagggcaacatgacatttatattgttttaaatacttttgtttattactttgaaaaggcattgaatatttttatgtttttaaaatgttaaagttccttgttcatttaatatttggagggaaaatatgaaacaataatataaattaaaatacataactgaaacttttgattttacagttatttaaaatattttttcaacaatattataatatcattcttttgtttatatttatatatcataatttaaatggtttattataaatttaaaatataaattatatatgaattaatatttatatactactataaattttaattatataaaaagtattatctcatgcggtagaataaaatactattaagaaagtatcattaaaaagtatatagcaattgtgagaggataagatggtgtagtatttttgaattgaaattacgtgttttagtagaaaaaggaaacaaaattgtaatgtagtagttcggataaagctgaaagaattgaaggaggcgacgatattcctagtaggaggaatttaatataataagaaagcagatggttgtaagttgtaaccgaaaggaggaaggggcataaccggaaaaggaaataaattagagcggaggcaggcgtcaaaggtcaaattttgaagcttccaaagtgggaatatgtatgttaggtgtttttcgcggatgatatcagatgttatgttccaaatttcactcttaattaaacacgaggaaactgtgatgaattgagagaaacactagtatataaatagagttgaaaatgaaaatgaaaatagaaaataaaatatttgatataactgtataataagaaagaagggtgaagcctaaaatgaaataaaagtttaaattaagttgaagaaagataaaagtgagagagaacaccgacgaggcagaaggagagagagagagtaataaaaaaaaaaaaaagaaacggacgaagaagtccgtgctggcaaaagattccctgattcattcactaactggttgttttatgttggtgcctgcctgcccagtaactctactgtactgccccgcttcatagttgctactgctctctctttctttcttccctgtggctgtggtgttaaatagcaattttggttacaattagaaaccctaaaagggaaagggaaaaggaaaaggaaagagccatggggtgtgccagctccaagctggacgatctcccagcagtggccctttgccgggagcggtgtggtttcctggacgaagcaattcaccagcgctacgcactggccgcagctcacatcgcctacatcaactccctcaaggcaattggtcactccttaaaccttttcattcagcaagacatgctaacaacaaccgatgctcctccctctccctccccttctccccctcacaaaaccaccaaacactcctctccttctcactccgactccgccggctcccacctccacttccactccgactccgacgaccttccctccctccatcattcccctgaaccatcctctcctattcgtttaggtgcttactactcaggaccagatcatccccatccccatcttcatatgaattacatgaagaataaagccgctccttcaattgtctacgagcagcgccctatgagtccccaaaccatgtacgttggagagtcctcctcttcctccttctacccttaccagtatcccccttacccctacacctacgatccctattcggccggactttcttcctcgccgcagcgccaggccgtttccaagccacccccgcctccgccctcccctcctcgctcctccacctgggacttcctcaacttcttcgataacagcgacgacaagtactatccccaaactcattaccctgccacggccacccccagccgcgattccagggaggttcgagaggaggaggggatccccgatttggaagacgaggattaccaccacgaagttgtcaagcaggtccatggggatcagaagctcgtccagcctcctaagcacgaacccccaccctcctcccaccacgacgtatatgatgatcatgatattcatgatgatgatgatgatgatgatgaggacgaagaggaggtagaatatgaggtgcacgtggtggataagaaagtggttggtggagataataatgatgggaacaagaccaaggagcacgccgcattccgtacccggcgacctggttcccggaatccaattgaggttgctaaagagattcagattctatttcagagggcttccgattctggtgcccaaatcgccaagatccttgaggtcggcaagcttccccacaatcgaaagcacgcagcttatcaaggtaacattaacagcatttctctctattcattattcacatttcgctcctcacttacctttacctgatcacgtcctgtctaccagcttcttccaagatgttacatgttgttgctccctctttgtcccttgtctcctcccaaccttctacttccaaagatgctgaatccgcctccgctgctaacatggattttaatgttgatctaacaaccggggcacgcaatctttcctctacgcttcagaagctccttctttgggagaagaaactctttaatgaagttaaggtatggatcttaattcaccaatctcattccattgctttcagtttttccacttttcatctccgtgaggcaatttaatcctgctgctttcgcatcagctcttgtatgttctaatgtaaccaacctgtgctgataatttgagtgatatcaactgctcagaagtcttttatgccataagtgaaacattgttaaccagtgtttacaggtttccaaatagcttttttgttagataaataattaggaagccataaacaataagtatagcagtagaataagttcaaatagaatcataacacatacaaagtttataataatcaattaatacaaagcttaaaatttaatagtagaagagtttaaaagagcctagattgaagtgcactatgcgctatccttatagagaaaaattcccccactacactggtacaataaattaatatgcatgcgctcctctcccaagatacgacaacccattaatccaatcgagtatggcgaaaggatcccgaaccaaagaacaccatgctccaaaacatatagttgtagtaatataatgtaattttataaaaaggagaaataggcaaatggtattttgctgtaggtgtgtgcctatacgttctccttatttttccataagaggaagctatatataaggggggaaaataaccaccaaatgtgcagcccaagtatcacaactaacaaaccagtaacaaacataactacaaatctcaataacgtgcaaaacgcctccaacagataaaaagactaaaaacttagtcaaacacaatttctaaaagataggaataaatagatagggaatagtttttatctttagaaaaaactgattgagaaaaagaaaattatttattttaaattttaaattataggaaaatattttccaacatttttttcgcacgttcatttgtttgcaggcagaggaaaagatgcgggtcatgcatgataggaagtgtcgcaggttgaagcgtttggatgataggggttctgattttcataaagttgattcaactcgaactttgattaggaatctgtccacaaaaattagaatggcaattcaggtggttgataagatttctatgactataaataagataagggatgaagaactgtggccacagctgaaggaattaatccaggggtatgtgatgttaaaaactaaccatttttgttatttgttcaagtcctaaatgtctctctgttcatgatgggcaactctgtatgtagggatggcaagtaatcccatatctatgctccaatccaatccaatccttccattccccccccccccccccccccccccccaaaaaaaaatccatttcttcttcctttccatcaccatgtgatccataaaatataacatacttttaaatgggtgggttggatatacgtccctaattttttttattaattgatgggttggatggttttaattaaatggatcaggaatggattggattttttcattatattcccaatggatcataaatatgtgaaaaaggtttagggtcatgtgttttctacacaaaatttgatttgatgtgcttctattttaggtgcttgtctattatcattgaggtgatatagaatgacctcatgcaaaatgtgtagatcatcttataacgagtcagtcaagcattttctgcctgttcagtggcactttccacttttagctgtttgtattggcttccagtaactgaactaattatgtgctctacaacattagacaaagattgaatggaaggggttattttgttattgagattccattccataggaatcatctcctctatatttcaaccctatgaaatgaactgaaatattgatgcacaatttcccagaattctttgataaccatggtgaaatgtatatatcctgacgaaatccaacaaatccacctgcaatctacacatagtgctgatagaaagaagcaaatacttggccatcttctaagaccatttctgataattttgataaatcctgctatttactctgatgtatgtttataacttccaaccatatgatcaatttggtggtttatctgtccaatttgtggataatgttgtgctcgagttgtcagccagaggaataatcattctttacaggggagatgatgcaaccacgcaagagcttttccaagaaattattactctccaatctacaagaggaactaaaaaccttaaaatatatcctgtttatccttgtgcaagtggattgagcacttgaattcagtattctccatccagttttccgttccagacatgtgtgatgttgtcacccatgcgcttttttattcttcttaagtttgtatggttgaattaatgttctcattttcttttgaagttgctaatttttttctctgtcctttgggataagacatgcatgtgagatatccattcatacatagtattggataaatgttttgccttttctcattgtaatgtaattatcacctgagaattgtttgggtgtctcgatgtatatatggtataatatgagataagcttattttcaggttgaccagaatgtggaaatccatgcttgaatgtcatcatgatcagtgtgaagcaattagagaagccagaatactgggttccattggatccaggaagaagagcggtgatagtcatctccaggcaaccaagcagctcgaacaagagcttatcaattggacattccaattctctggctggataagtgcccaaaaaggttatgttagagcattgaataattggctgctgaaatgtctcctgtatgaacctgaagaaacaccagacggcatagtcccattttcccctggtaggattggggctccgcaaatatttgtaatatgtaatcagtggtcccaagctttggatagaatatctgaaaaggaagttgttgattccatgcatgtatttaccatgagtgtgcttcagatatgggaacaagataagctagaaatgcataggcaggtgatgaagaacaaggatcttgagagaaaagtgagaaatatggatagagatgaccagaagctgcagaagcaaattcaagcattagagcgaaaggtggttctggtatctggagaaggtaaaggtctttcagtttctgagaatatcatatatcagagtgacaaaagcagtagtctacaggctagcttgcagtgcatttttgaggccatggagagatttactgacgaatctgtgagagcttatgaggagttgctacaacggagcgaagaagaaagtgctgcccaaaatcatgagagagtttcatagggtggtgtagctgatggaagttggaatcatattatctttgccatttaccgagaatagaaactagctgatctccctctactaactattctttacaacagagtcttgggaggaggggttgggtttgatttctcactacgctaagctaactgcattggagctgaagatactgctgggatgggacagtggaatttattgtcaaacgaaaagataagtgtgaggtatgaggcgcacggttgctttttgggtattcagtgctataaggctacaagtggagttgtgctgctaaaagacaggggagcccacaaattataacatctaaatggttcttctttctgcattagaaaatagaaatgaaggagaaggacggactttcaggtatagaacccctgcaactggcaagtcgtgtgctagaaggtgttcattgctcaaattgaagcagtaaaattggaacaagtctcgttcgcaacggagtggagtaacgcacgtcactgaatgcatgggtgttattggttcctgtataaaaacattcgtttttaagttaaattattgtacagattacctattaacactgagcaggcttgatgaaaaagcatttagaataaaatatttcttatagccatttgttcctcaactggaataaattgctgagaactgttcaaagaatgaaaacagaactccgttattaaatgcaaagcaacttaaatctgacataagtggtggtgggctcttccgtgaccaactattgttcatgataagatagacaacggagattggaacgggctggccaaaccagactccaagagctctcaaagtgaaccaacctcttcaccaaggctgctcaaaataaccagttttaaaaaaataatcatacaagtagttataactaattttatagttacggttatttttattgaaaaaatagttataattataaatctataaaactataactagttttatagaaatgattattttaaataacttatttttattcattcaaccggttatgtaattgattttaaatataacttgttaaatagttgattatgcaattagtttattcataatctgttatatatctatattttaaaaacaataacaagttatatcaaattataactaattgtggtcataattataatattcacttataatctagttatttattagagcatggttgaaaatcagctaaaaaaataagtcatgttgaagtaatttatttagagcatgttgaaaatcagctaaaaaattatttttgagggaaaaatacttttacaaaaggatcaagatctttacgttttctttcattttatttttatcctttggacctacattgaaatgtataacacaacaatttcaactacaaaccaaacatgcatttagggtatattagaatttttggtgggagggtccaaaaatatgtttaaaagtaagctaaaatatatttgtgatctataataaatatctaaattttttgtttactccttaataaattttttcttcatttttactttcagataaaacaataattttatttttatccttgacactttttttagtttatgataaattagcaaatgaacaaatacaaaatttactaatttatcatgactaaaaaaagtgttaagaaccaaaaataaaatggttatcttattagagatttaatgaagaaaaaaagttatcaaaaaaaaatacaaaattcaggtatttattaggtttacaaatatattttaaccttaaaagtaaaatgattttgaaattatgtttaattaatatctccaaaatcaatttagaaacttaagtttgacctataagattaatgtgcaaatgaaaagagaaaagtttattagacaacatggaatcctttgcaaatcactccaccttgcacattaactctattaacatttatatatttttttcttctatttttcattctattatattatatcatctatagtacttataatgtttttgatccttttttgtctctctgtcaaatatcatatggtgtactctcatctctcatcattttccatttataatccaactttttggcgcttgctattgtgaggtgttaatgaactttgcattttgttcgcctataataagtaggtgcagaggtgttttcgagggattggattgtcagtgctgctaatctttgtgccaccctacggaactgaattattcccatatgatgttttttacttcaattattgacatacggtaataatattttgtctgtaaaattgtattacttaattgcattattttttttcatatatccgtacaaggaggggggcttactgcttacgcgcaagatttttattttattgttgtccttttcagcccttgttacgaaattgaaatgtgattcttgcgttgcgtggtacattgtcatttaacaaaagctgcacaaagatgttattggttattattgaatttgaatagggaaattttggctagcagacattgttaactgcttatcatatgtaataattgattataacatgcatacgttacattatttatgaaatatattttataattttatttttcttttttaattatatgatataaatgtattgtataaatataattttgactaatgtttaatggaaattgttgtattaacaacactccaagtaaacgtacgaaagttggtgtaaaatgtaagaaaatgtgtcatccattgtaggcttttttcctaaaagggaacattttttttttctttattaccatttagagggtcaattttaaataattatctaaaaggggataaatcgtaatagatgttacaaattttaattttttagtagaagtcgtaaatgagtttacactttagtttaattattttttaaaatttacgattttaaagtcgtattaatatttaaaaaattgaagttgtaatattatttactactttaattttttttaagaactatgacttgaaagtgataatgttttttacaactttcaagttgtaattttttttcaaatattaccattttaaaaaaattatgaattgaaaataataaataatattacgacttcaattcaaaaaagtaaaaaaaaaattgatacgattttaaagtcataaattttaaaaaataattaaactgaagtagtaaattctttaatgactttagttaaaaaaaaaatatgttacgggttttaactcaaaagttgtaatcgtattacaacttatacttttttggataattattgaaaatcgacccccaaatggtaataaagaaaaaaaatgttctcttttgggaaaaaaaaagctcgatttgtaggattccatgttgtatgataaacattagaaatgagtagggcaaataaaatcataggttaaattagtttgttggttttctaattgattttttaagtttgatttgattttttaattttttgagatttaatttgttctttttaaaattgatttattttgattctactatgtctaaattgagtcaacggtattaagaaattatattgtgactgctgaaaatcatttaatgataattttaaaccgtcgtaaaatacatatttagacactaagatcaaatttaaatgaaagaatcactcaagttaatgtaaacaacatgatcaaattaaactaattttacgaattagaaaattaaactgaacaaaaacaaaatcagattactaaatcaaatcaattttaaaaattagatgactaaattgaatatgaaaaaaaaagcaacatatccaggggggggaattaaccaaaattatataaataattataattataattatgtttggcggtcacttcttagttcatacctatgttatgcagcacgaactctcaccttaaaaaggaaaaggaaaaactttgacttgattagaatatgcatcccggcacgtgatcaatggtaatggagaaaacatttcacgaaagggagagacaagtcttaaaatgcagcattgagcaacttaattaaacggatctgcgcagaagcttccctccaatcagattattcttttttggtttcagattctcaactttaggcaagtgaaaaggtaaggaatcagatttatactagaaagaacaactttcagccataacaaaccaagccttttaatatttcaacacatatgatttattagataaaaatgtaccaaaacaacaataagttattttaatatataaaatttattagataaaaattagatttaaatgtaattttgatttttctattttattcaattcacaattttgattatttattttaaaataaaaatatttgatcattttattttaaaaatttataattttatcctcatattttttagaaatatgcaattttaatctcatctttaattttatttgtattttatttcttacattataattaattaaattatttttaatgatattttaaacaaatatgttaaatttaagatttaattaaatcaaaataaaataaataaaagatagataaaattaagaatttaattaaaattaatttttaaaatcatacaatttttaaaacagaaaagccaaattaaaatgaaaagattaagcaaaacaaagaaaacaaaaataactttgtgtgatataaattgaacccatatgatgtttatcttgacttgacgtgtctaggttgagatatattagtcggcaaggtatcattggtggagctagctagatttggaagatatttgtaatgtgtcggaaaaaccaggtaggaagtcagggaagattttacttttccgtaacaaaaaaagtggtggtgtcgtggtgaatatatataaataaaaaagaaggtaaaatagtaacaagaatgggaagcattgatttgggtaggtgaagactgaagagaagcagaataagtaagatagggttgtagttaaagaaagtatggataaaaaggtaatattgaggaagagcatatgatgaagttggaaatagatttaatagaatattaatgagtgctggattgtaataagtaaacagtgattagtaattagcaacagtgagggtgaaggaagggaagggaagtgaagcatagcatagaaacaaggaaactaaaaaaattgccaaaaaggcaaatcacgcgaacacaagagtagaagagtatagagtctgtggagatctcattcatgatcggtgataattgttgaagagagagagagagaggatgggttgttgccaatcatcgatgttgctgagagtgggagagagggagactcaccctgatcaggagaaggagaaggagaaggagagggaaaaggaaaaagagcaagcgtacggaagccaccagaggcagtctgagggcgagaaagagggggtggatttctcgttctcggagttctcgctggcggagctgaaggcggccaccaacaatttcagctccgagtatatcgtgtcagagagtggggagaaggcacccaacctggtgtacaagggtcgcctccagaaccagagccgttggattgctgtgaagaagttcagcaaggctgcttggccggatcccaagcaattcgtcgaagaggcttccggcgtcggcaacttgcgccatccacggctcgctaatttgatcggttactgctgcgacggcgatgagaggcttctcgttgccgagtacatgcctaatgatactcttgccaagcatctcttccactgtatgtgtaacttatctgtttgttatctgtactagtgtttatctcatctgttcattcattcattggttcattgattcaggggaaactcagactattgagtgggccatgcgtttgcgagtggctctgtacatcgcacaggctttgcattattgcagttctgaggggcggcccttgtaccatgacttgaatgcttaccgtgttctcttcgaccagcaaggtgatccccgtctctcttgctttggttttatgaagaacagcagggatggcaagagttatagcaccaatcttgcttacacacctcctgaatatttaagaaacggtaactaactcccttcttcacattttcttttttacttttttatgtataacaatacttctctcaatcatatttcttttgttacaggaagggtcacgcctgaaagtgtcatttacagctttggaaccgttcttctagacctcctcagtggcaagcacatccctcccagtcatgtaactgccttctatccttaacctgcccctctcttctgattccacatatcactaaaagctgtaaatacctctatgtttttaatcaagccattttaatcttaacatgcaattctcactttcagtgtttttccatcttgactattattgtgttaataagtgcttgttatgacactatttattttgtcgcattgaagttgtgactgtacctcaaatgatattacgttattgttcaataaatgaaacatgatcttatacgaatgacaacttaaggtatggaaacctttctctttgattaaatacttaaatacttaataatggaagttgatgatgctatgatagttatttatttaaatttaacgtcaattcattttccatatgctcacgtgttcaattagttttcttcttggttggtgccatatggagttatctgattgtgtttgcaggcacttgatatgatacaggggaaaaacaatatgctcttaatggattcacatttagaggggaagttttcaacagaagaggcaacggtagttgttaatcttgcctctaaatgtttgcaatatgaaccaagggagcggcctgatacaaaggatttggtcacaacacttgccccgttgcatacaaaacccgaagtacagaccccttctctaacttaataatggaacatatgatttactggaactttgttgtttcaacagccctatcaaatattccattatcacctacacaaaaatttatgttggatgttaatgtctaatattaaaattctatgactttttatatttcatatttgtttctttggtcactcatttcaaaattgaatctacatggttggggtcgcttagctcaccatcctcaacttacataaaacatggtaattcaaatattaggctggaacattttaaattgtctttggagaaaatttagttgaacctgggttatttgcaaaagttcattttgactctagggtttctttagtccgtaaacttttccacttgcttgagatgatataatattataagggttttctgtataagtaaggttaaaagatgtttgatatgtcaagttctcaaacagccaaagtaattggtttatggttctagctgacttgtgaattctagttagcaaagaattagtcatctttgctggtttggtccttgtttcagagttacattaataaacttcattcaccccaaaataaatcttgtgtgtactactgttagtttattacttgtaaaggatagaagaaattttagtaattttcatgatgtgatattgtctagaaatataggcatatgaccttcaaggaatctgttctttgtgtacatctatctcaaagagcttagtcaagacttattttattttatttttaaaatctatagccagttcttagaatttgagcttagggcataattcagcccccacaaaattggtattaaagtggcttctaagttgaggattgccaaagccttcgaaagactacattggtcatatatttagttgatgtgagatcttaacacaccttcatgcctaggaatagacatctagagcatagacaaatactggtgacccaataacggatgtaggattgaccttgataccatattagaatttagatttatggtctaactcaaccccataaaatcagcttgtaaagtgaggactgccttttgaagttctagttaagtcgcatctctaaggcaggtcaaaaaggccacattaataggagtgacagcaattaaggtgactttccagcacaccctctcacacctaaggttatgggcctagatgttgcaattgggtggcccaacaatgaattttggataggctttgctaccatcttggaatttgggcttagagcccgactctaccctataaaattagcttgaaaaaaccaaattgatgttagattttaacaccttttgcctcacaacccaataacaataccctctcatgcctaggaataaccatctagagcatagacaaatacgggtggctcaataaaggatctaggataagctttgatatcacattaaaatttgggttaggcttagagtgtaactcaatcccacaaattgacttataaggtgcggattgctcaagctttatatgctctatttaagtcgtatctctaggtgatgttgggctaaacacactccattgaggctgtagtttagccaactccccaggaggttgcaattaagaaggctttcttaacccccaccccccccccccccccttcttctctctcaaggctatataggctcggaacatggtaatgtgggaggcccaaccacgaatctaggatagatttttgggatcattgaatttgggcttagggtctatctcaattccacaaagctgactttaaaaattcaatttgtaaggtgacgattgtccatgccttataagaactacattggttatatctcaagtcaatgtgggatcttaatgcgcccatgacccagtaacagcccttcatgcctaggaataggcatctagaatgtagacaaatacgaatgacccaataatggatttaggtttagctctaataccatcttaaaatttaggcttagggcctaactcaaccccacaaaaatggcctgtaaagtgagattgctcaagctttataagctttatttaagcttataaagagcatagtcaagactttttatctatagctagttcttaggatttagggtctaacttaaccccacaaaaccggcttttaaaaaaccagcttctaagttgaggattgtccaagccttataaggataacattggccgtatttctagttgatgtgagatcttagaatttaagcttaggaactaactcaacctacaaaattgactttaaaaaaccatcttgtaagttgacgactgttcaggccttgtaaggactacattaaccttatctccagtcaatgtgaaatcttaacacactccttgcgcccatgatccaatgacaacaccgcctcacccctgggaatagaaatctagaacatagacaaacaaaaatggcctaataaatgatctaggacatgttttaagatcatcttaaaatttaggattagggtctaactcaaccccacaaaaccaacttgtaaggtgaggattgttgatgccatataagctctattaatccatatctctaggtaatgttggaccaaacacaccccttgagactgcaattaaccaaaaatgaatttaagataagctttgacaccatcttagaatttgggcttaaggtttaactcaattctacaaaattgacttttaaaaaccagcttgtaagattttcaaaaaaagaagaaaacatcttgtaaggtgaggactgcccaagcttaagagtactacattggctattctctagttgatgtaggatcttaactctcccctcacacgcatgtcccaataacaacatctcttcatgcctaagaacatacatctagaccatagagaaacatgggtggcctaataacgaatctttgatggactttaatgtcattttagaatttaggctcaaggcctaactcaactccacaaaactggtgtgaattgcttaagctttataagtcacttctctaggtgatgtgaaactaaacacacctcctccaggttgctattaaggcaacccccaaatcctcatgctcatggtggcctaaagcatgacaaggcaggtggctcaacaatgaatcaaggataaattattaacatcttagaataagaacactccctcacgaccagggataacatctagagcatagagaaatatgggtggcccaataacaaatctaggttagactttgatacttgattagaatttgggtctaggtcaaccccacaaaatcgccttgtaaggtgagtattgctcaaactttataactctatttagaagctatatttctaggtgatgtgggactaaacacaccctttcacatctacaattaaggagactctgaagaggctgcaattaaggcaagctaagggtaattgcaattaaggcggttttccaacaataaacaaattttaattcatatttttcaagcattttaaatgtaggacaatctagtacacaaggctccaacctaatggagtttagggagggtagatgtatcaggctgccttacccctgtgagtggagagaggttatttcttggatttgaatgtgacttcaaagtaagacaacaatgttatagttgttcaaggctcgccctctatgtaagcattttaatttgtgaatataaaactatttatgtagactcttaattgtattgcatttatgcattatataaagacattcagttggataaggataacccaattgttagactcgcatgatttcaaattttgagcttttggtcatacacctggttgaatgactttagggctgagcccggtgttacttttaagtttgcatttacttgcagtttgaaaaatcttaaactatatgatatgattttcatgcatgtacattgaaggttttgaactttatatagccatcggataaaatttagttatctatctataaattttaactttgcattcatgcatatcttacaagaatcttttaagcagtatgataaaaatagggcacaagccaaactagttctatctttgcaaggctgaacgtgactaaagaaagttcttccatgctttttgtatacttttttcaatttgtcatgcatgcaagtatttttattgtcttccttgtcttatcatgtatttctcagtgtagaaaactagagaagggattaaagatatatattgagctatagcaattccaacatcttctgtcacttgatatggaaattatccttgttaaatggcaatttagacatataaatgggattaaagcagaaacaattctagttgactattattatgtgcttcaggttcgttctcatatcatgcttggaattccaaagcatgaggaagctccatcaaccccacaacgtcctctttcagcaatgggtgaggcttgttcaagaatggacctaactgcaatacatcagatcttggttgcgacacactacagggacgatgaaggaactaatgaggtaactgatgggtgcattggttttaaattttctatttttaattggatgatgtgccataaggtttgaatttggattggttcagttgtcgtttcaagagtggactcaacagatgagagatatgctggaagcaaggaagcgtggagactatgcattccgtgacaaggactttaggacagccattgataactattcccaggtgcaattctgcacttgtttgacattgtaaattattgtagctgtgctatgtgcacgctaattattttgagatgcttctgcattgttattcatgcagtttattgatgttggaacgatggtctccccaactgtgtttgcaaggcgcagtctatgctatctgttatgtgatcaaccagatcctgcactacgagatgcaatgcaagcacagtgcgtttatcctgactggcccacggctttctacatgcaatcagttgctcttgcaaaactggacatgcacaaggatgcggctgatatgttaaatgaggcagctgcattggaagagaagaggcaaagaggagcaagaggatcatagttttatgcagtgggctaatttgagggtgtcaagttctgtataaaggttgagctgggaagcaaaactaacgtttgaatgagtttaaaatgtgtcagagaaatacaaaaagtggtggagtagatggcacatgcatttttatttcaccatcttataggaatcggttacaacttgaaaactgtgcttgtgcactctaaattgggaaggaataccggtaatttttccattgttaatgaaattgattggttgatgcctactgggttacttactgtcaaacaggtgtttattgaggttattctaactcttcactggtcaaggccatggtgttcatgacattatgtgatgcctgcataattcggtttatttttcaatgattggtaaaatcctgaatacaaagtaccggcccatgcccatcggccatagcagtaggcagcatgcacgatttttaatccagcgctctattttgatctttagagatatttaaaatacttttgtccagtttatagaaatgtaaattataaatttttgtttctctcattacctttggggtttggtttgatattcccttggatccttttagtttaggacagcttccgttactttagcctatatcataccaaaagctactcctactttcaaagttactcgtgcttcgtctagcgtctattgtacaaagataacataaacgttagaaaattttatgggtttgaaatagtagtataagttgagaattttagatgctgtcttaattaacttagtatatcctttatcataaacacttagaccccattttctaatattccataaaggtaaaccagttcaaagggaaaatgttttaccattaactaacatagaattgttctagattaatcaatggtattaaattcacattttgaatatttaattgtgttaaatatttagagttagaagtgaaattttgttgttcataattctatttaggtcgagtaagattatctttcatattaaataacttatctatacaggaaaaaaactgttttaatggtttcagattatatcgattgattttgccatgtaggtttttaaacaaatgtcaattctcattacttttcctaaagtgggtacatgccaacaaggatataacctcatctaagttccgagtgtttacagattggttgattcagttttaaggaagagaaaaatgaactaatcaaaataaattagattaggcggagagagggaaaccaagttcatcaagaaggaattggtttgttttttggttgatgaatttggtttccattctttttttttggttgatgaagttgctccaaaccaatagactcaacgtaaatattaatgttttttattagaattttttggtacattgatttttgggtacattatttacttttgatttaatgcgacgtcattgtagtatcatcaaataatgtatcttaaattttatatctatattgttcaaaaaaaattactttcttatttctaaaataagtgtcattttaggtttttttttttttgtaaatcaagaaaaattaataaataaatgaaagataatagtaattttacaaaattaaccttaatgttaatattgcattgcaaaactaaagtgatatttattaggattatcaataaaaaaataattaatatcatattgaaaagataaatgcaacacttattttgatttttttcttttcaaatacgatatttattttggaacggaagacttatatgcacattacttgaggattttaaacttaaaacaattaaacaaaacacttacattctagatcaacaattggtaaaattaattgttcaaataatttataaatataaaatgataataacaaacatgtttatatgatatttttatacaaagtttaattttaatttattgatcaaatatattttaggataattataattttattttttaattgattttaaagttttgcaatttttatttatagattaattattctaattatatttttttagttttaattattatacataatttcattatgcattttattattaatcttagattttatcttaaaatgttccaaaccaagtataaaataaaataaaataacatactcttaagtagatgtcatattttcattatgttaattagtggactagttaaaatatttcgaaatatagtgttaaaatcatacaataaatcatgtaattagtttaatggttttttttagtaatggtttaaataaatagtataagagaaaccaaaaactaataaaattatgtcttacctaaaaaaagataataaagaaatttaataaatattttatggataaaaatataaataaaatataaaaattagaagttagtattttaaaaaacgttatttgaagtaaagtataaaaaatgttataaactattaaaataagtttgtttataaaacattgttaataaatttagacaaaattttcaaataattaaaaaaaaaggttaaaaatttactaaaagtatttggcaaaacatacacaaagttaacaactatttactcgattacttctccttctatgatgaccaaaataccaaattaatcaatttatattcactctccactttatcattaacattgttatacaaagtaaaccattcttaagaaagggatgatagaccaaatagagacatttttaaaaacttttttactatatattaaaaaaggctcttccaaaacatattataaaataatttggggtttttttaaggcatgttagaacaaaattaccaagttaattagcaatttttgagccacgtattattattttgtatatataaaaaaaaaaaaaagacttgcacttaacatgcatgctaaatattgttgaaccaaaagggcgtaaagtgagagagtatgccaaagtgctctattagggttggggtggagacttcaaaagaggaggcggagagcagggatgtgacgtggcaggagccatagaaggagtgcctccgcagtccgcagccacagtctaattaaggaggacccacgcaattaagtgtgtgttagcctctgttaggggtgttcgtggtctggattggatcggttttgaagcaaaaaatcatccgatccaatcccttcggtttggtcatttaatcatccattcggtttaaattttttttcaaatccgatccaatccacaccatttctaattttcattggacaaacatgttcattggacaaaataaggagcaatatattgaatttttgatttttgggctatgatgaggaataggcccaagtaggtaaagggtaaggtatagtttataattggatcggtttggattggatcggtttccactagtcaatccgaaaaccgatccaatccggtgaaaattttcggttttttttggttttcggtttttcggttttcggttatttcggttatcggtttttcggttcggtcatcgcggtttgcatcggtttggatcggttgatgaacacccttagcctctgttaagcgcacacagagtcatctcattttagaatatttcaccctaaaattttagatgcatgtgtttacgataaattcgtaaataaatagattacacttcaatataaagaaaagttatttcaagatagagagtcttacctttaagaggctttgaatttctaatccgatagagaatccaacccaacttaacttctataaatactagcaattaatgttaatgtatcaggaaaagtggtaattgaatacatttaatatatatcattaccttggtaaaattcatactaactcgagtatcattgtgtcaaagtgttctttgtacaagtatatattcacccatttttaatggtttagtctcatcagagcatcaggcaaactaaacagattttggatattaattgatcagcggaggagtgactagtccataatcaacagtccaccttggacatattagcatgtcagacacaaaaaatgttgacatcagatgaatcagatctatgaaaagtaggggaagatgaagtagtaaaaggaatatgtgcacaatttaatttccctcaccaatgtcaagacttgaatgcaactagggtttgaccacaaaatttcttcatgatacaatgaaaacacttgagttttttttgccttttcaaaactcaaggcagataataatgatgtttacaaaatgataattttgttttcatttttttttttgaattataatttttttattggatatatatatataaaaggttaacttagtgataaaagatgtagagaggaacaaatagattgtggattcgattcctctcgataataaaaactaacaattaaaaattaatattttactgataatatatatatatatatatatataatacaaaaatatgataaaaaagaaaattctaattaaaaacaaaataatttgattttattaaagaacaaaatatttgttatgctgattattttttaagtattttttttttttttgacaaaattgcctgaaactcatgttttcttaaattcaattgtgaatattattatgctagtaatacctatactatttttggtgtaagttttctatgagattaaccaaaggtaagacaaatgaattttagtacaattggaacatgaaagaatcatacaattgctatatatattttgggattaaaagttgaattgaaccttttatgaaaattatatatttttcaagtggcgtctttttgaaagaaaagtgacacctctcaaatgaaatgatgtatattttaaaaaaattataatttttgaagtaattttcatttaatgaaaaatcacatcttttttacttgatatcgtatatgaaaactcacttttatttttaaattattctttacgaatagatttgtattttcaatgaaacaatacaatcttcaatatgaaataattcagttttcatgaagaaacacaacacttcatattttgaaaatttatgacaactcataaatttgacactcataaaaaggttgagtttaattaataggtatttttttaatgttaaaattttctttttattgttaatcaatcaaaaataattattagtatataatatatatgatgattcatgattagatgatagtattaaatccctttacatacatatccatcaaatatgaagattaaaaaggtgcatgtactttagaaaatgagatatttttttagaagaaaatgaaatgttaattatttataataattaattataattaaacagttgagattataataaaaatatttaaaaaattcttctttctttatttctttttttttcttattacattatttatcatttgtttatctccttttttttttttaccaatatctctcctttctattactcaaattttcacaataaaatgggatagacgaagagattcatacatttttttgaacttgaactgtgaagtaaaataaattaatgagtagcgttatatctttttactgattttcctacaatttctcctattatttaataaagaaaccactaaataaaaagtaaagtattttatatctaataaaataaaataaacttaatacttatcataaataaaacagtaaaataatgctatgatatagtataaaattattcgaaattaaaataaagctcgttgcaaaaggactaagaaagagctgttctagcaagaaaaggacatgcaccttcaaattcatcgcgtcaactccgtaactccatatactgacggaggaaacatgtctaattaactttaatcatacaattattaatttatatttaatcatttagtttagttatacgattataaataatttagtgatgagaatgagatgataaacagggtggctctgctccagcacctggctgcagagggaggtgacgtggcctgcttggtggtttgacttattggcacattcatgtcatataacaaatacatatattataaccgcttcattaaagtcttcagcatttgcaaatccatattatgcatgttataccaaaactacaaatatactcattcgtgtattgggctggagtttaatgaattagaaatacataataaccaacaattaacaaagctgtcttcacagatcagcccttcttcattcaagaaatgcaccataccacctgcagacagtattctatataagatttttgataaatttctttaaaaatacttctaaaaaaaaaattagatgaatttttcataaataaaaataagttttccattagctaacttttagaaactcatcaatatagtttctctaaaagatgagatgacatatacaaattaattaatggaaaactcattttaccttatggaaaagttcattttattttttttcttcttattttctttttctagaaatacttctagataagtttacacccaaacaggtccatactcgagcagatctagacgaatgaggatttaattaattcatatttttgtcattttgagttacaagggagatgtggctttgagaccttttcttccttctcccctggaggaaattttgaattgatttctttatggaaaggcctggcgagacatgtatcaatagtgcttcagaatgcaagccggtagtgctttcctccatttcttgacttgctaaccatattatcattcttgcctgcatatatatatttttatagtattaaatcatgagtttaatggtgatgtaagaccatctaatcacaaaaaattaccatcgttgatataatcttttagataattttataaaattcaacaaacttatcatatatgattaattataattagatgattgtattttacactatcaatgcataatctgttttctattagttatttagttttataagcgttaatttaatttgacacatctaattatttccttccatcaaaattgtgtaattattttatcttattaatttcttttaaattcacaagcttgcttctcccattttgtgagctaaatgctgatttccagttttggagaaaaagataaggcataatcccttcttttatttcatctatttaatgtttcaagaaattctttcataccttcaaaattgacgtattattttctctctctaaatttaccggtatcaataaggggaaataaagtatttcaagaaaggacaactcagttaaataaacttattttttaattaggacaatttaataaaaaataaaaaataattttaaattcttaactaatgttcaagggatacaagattacaattaaaaacagttatatttttttaccaagaaaaaggcattatatctattaatccttatttcagttttatgaattgcttaattaaaaaatttacattcattaactaattcatccgttacttttttagtaataaattatagaagatatattattttaattatttcaataaaaacaatatagtggaataaacatttttttatacttataatcgaatttatataatttgattagatcttataaaataaccttttaaaagataaataaaattgcatgaagagaataatgatgcaaaattttattatgctatcaagtacagtcttgtttggtaacgcttaaaattgaataaataattacttagtttttaataagaataataagaataagcaattattcatttaaaataagttaaaggaaacattcaccgagtctgcagttcttggaatgcaataaaaaaaaaaatggtttaaaaaggagttaaaatggaaagatagaagattggaagatactataacgtatacctgaagttctgctgtgtcaaaaatgcattggcgtcgtccattatgaagaatagctacaagtttattgtggatgttcaacgtcccattcctgcaaaaatcttgcagaaaaggagggagaattagcaaataacgtaagaagaattccacttgcttaattcctgagatatacaaatgaagggagtcataacgtaaatattgaaaagaaagagtccagattgcttgcattgaacgatgggaaggtgatgaagacggaagacgaagatccaaatagcagtttctcttcatgtattaatttgaaaaatgaaaaatggaactattttgtaatgggtaacaaaagatatggcaattaatttgaaaatattggagaactcaattaaaaaacacagggagttgattacgggaagggtgttatatacaaacatagatgaaaaaatatgtttggggatgtgggaaatgagttacacatgcccaaaactattcattatggttatagcaagctatagctcttatcagttgcgtacccgcggcattcaatgcaattactaactcaatctgtatttcatgtgccttcttaagttgacagctatcattgtttgctcttctaaagtacaaaattacccaaattggatatttggtcacttggtcgactttagttggttttactttctctgtgtaaccactcttattgcattatgcatctcttatactacgtgctctctctaatttctttcacgtgatagaattcatttcaaaaagacatgaatttatatatatataacaccctttcattcagctgcctatctatctctctgttggtcattttccactagtaacttctatgtactatttcatatcagcacggattattataagctattcgatgaggaccttaattaaatatgttaaatattatttcaattatttcgggcatatatttaataattccatcaacactaatagggtccttaattagtttttccgcacaaaacttccaattatttgttgaaaaattgactattgcatcagcaagatgaaaattgaccagcaaattgactgtgatcgtctttcaactaacttctgaactgattttttcaaaattagccttcaacataaaattaaaaaaaaaaaaaaaaaaaaaaaaaaggcaatctgagagttataatatttatatttcttttttctacaatatcttttacaactcttttcctccaaattctttttatcacattatctatctcacgtttctcgtataataagaaaagttgtataaatttgaactagaaacctaatttcttaaaatctaaccggatcaaagagtactacacacttagattgttctcatgtgtcacatgccacgtgtgagatgtttttatttttaattttttaattttaagaagacgtgtgtggttgttctacccagaaagagcaagatatatctaagaaatcatgcgcttcagttcataggcctaatatgccaagattgttttgagccaatgggacataagaatatgtagcaaaatgaattttaaccaattgacgactgtaaagtgatttattttgaaaagaatgttgacattttcatgtaattatgtaaaaaaacaagtagaaaagggtaaatagtaataaaaaaatgaatggtaaaaaataaaatgaaaaaatgaagaaggaagagtaaagagtaaaagatgaggaccaaacacccaatccctctgagatggacgcggatactacattatccagtgcaaatttttttttcgcaagttccataagtgattaaaaagagcatcaatcacatacaactgtgcaaaggcacaggcacaggcacatccgtacatgcagaatgcattcaccccaagtgtaatcctttatcgatgataaattcctaactaacactcactggtggaaatggtgttcacaccttttcatacttacctccaattccaaacctggttggcctacttcataatcttcaaagcaagcacatggtttaagcattttgtcttttcagttaaagccacttcctagaggccgacccctgattctgaactaatctttttttgacagagattctgaactaatcttaagaggccaacatcacaacttattgatcaaaagaggcaacatatgtttatacctctgatgagctcaccctgctatgctgaactgttttccctccctcttgcttaataagaggaccagtacattcaaaaacgggatttttttctttctaatgtcatcaagcattagatcatagtctgtgctttaatttggacttcactcgtgttttcttgcattgcaatttaaaagagcattatcctacttctataaaataaatttaaatcttcacatatgttccaaaaaaacaatttaattctacacaaaataacttttataccattattctttttcagttaatcatgtgtttccttcaattaatgacacgtcttttaagttttttcataatatatgttaaattattattgttcttaaagtaattatgtaattaaaacgtttttttttttattttctttaataatactcactctccataccaacttctcacttacagaatatttttggcccataaatgagtttgatcgaagctggctaggtcggttttatactagtgtttaaagttggctatgttctttgagtataggttttgattatcatttcctgtttgtttgatgtctgcagctgtcttctttttgtatgatccgtcacctatcacttccacaatcaaagaagagcaaggcacttttcttcatttcattactcgactttgtgcagttctaggtgaaacctttgccctaacaagattttgtcttcaccaattatccaccattttgccatatcaaaagtgaattgtcctctgaaaggttgagatgtggttattttctttgtaagaaatggttaagttggaactgcaacatattttttgtgcttgtaattagataattcaactgcagtttggcactttgaataagaattaaagatattgcgactaaatttccctaaattggtttttccattgtccttattctaaaagtgaactacggtatatatatttccggcaactcccctgcatctgtaagatttagaagctaagaaggactccctccattaaaaggatggtggcatagatgaaaattattcttttcatctcttccacagatttgtgtttgtataattccatgtattgcgggacattaatggctagcagttcataatctcctttgcttttggaaagggtatttaggggctctccttcgcattacattgcatggttttgtcatagctacgtgcatgtggaatcaatttctcatagttttgcccttccatttcccaattttataaatttaaaccgcaactggctaactgaaattcatgcactctatctaggacaccttaaactgtaacaacttttcctttttattcatgcactctaacaaatcgccggtagtaacttgagggtgttttcattaatggggttgaattagtcgatgggattgcttgtcagtgaaaggaaagagcataacatacaaaagtaacgtttaactatgttaacaaatatcatgattcacaccttcaagtggaaatcctcatgtttttagtgtaaaaagttagtaaaaaaagaaagaaaaggaacaagtcttcataaccgaggaagactgccctgaatcagtcgcatcaactgttgccatgctgcggcagatgattctcttgttgtctttgtcgctgatgatgtcctccatcttcctgtacctgttcttgtacatgctcacgatgctgctgctctgtccagttaacattttcaaaggaggattgaacctgcctgctagttctccatccgatgaattccataacgagagaattcatactgatggcaatcccaaatccagtgaacgaggaaaggagaatggagagaattgcattaaaattgagctacaaaattgaaaaaaaggtaaatgtcaaaatatatatttttgctctcaccgagtgccaagtatcttcatgaagtcaggataggaactatatcatcttacaatagtataaaatacatgagctaacaggataagagttgcaaactggaagcaagcataagcccatacgaaactcctgctcactgccaccacaacaacatcactcatgttaatcagaaactaataatccagtatcatgtagtctacagcataggattatagcaactccagaggatctaatgaacaggtaaattacagagtatgggccttgttctaatcaattctcgtgtcagaatcattaggataatgtcaacttcttttaccatttatttgttttaaatcagacattacacaccaaatcagatgttgcggctgatagaaattgtttctttgaactcactaaacttaaaatgaacaggaaaattacagagtatgggtcttgttctcatgaattctcatgtcagaaacaataggacaatgtcaacttgtttcaccactttattcgttttaaatcagatattacacaccaaatcagatgttgcagctgatagaaattgttcctttgaactcagcagacttaaccgtatactccatttgccaaaacccaaacaaactttgtttcttttaactcacctgacttaactgtatcccccaatttgccaaaacccacacataatctggttcgaaatcaaagtccaagatttacatttaattacacatatcaagatccagtacaggggtaacaaccatgcattaactaaagagaactttgaactgtagccatccacccacagtaggacaacaacatcaatgcttttttccacaggactttacagaagaaaactcagggaggagggaggaggaagaggaggatatggatcagcaccatttagagctagaacctttataaagttttcttaggtctccatccactccttttaattggactaccttccatttgatatttttgtcactaaggctcctactgctctttaaattaaaattatttaacaatgttggcttctcccttagcttaaaaactattattatagaaccctggcccgttataaaagcaaatggaagtcaaaacgtcagatgttaaagggaaagcttctgtgttctggatcctcccagtttgttaaagcttacaaaaatgattctgcagtataagtttttggggggcatttttcataagctgctattttcaacctatgaaaaaagcagtaaaacagttttttaaaaacaaaacatacatataaaaatcttttacttaaaatatagtttatattcaaaaaaagaaaatgaaaaactcatataaacaagcaagaaatacttgaaaaatgcttattctcccatttttttgggggtacaggaatgcttattcttccttgataaactagagttagacgcttagtaattacagtcgtaatgagggtaattctaaatagagaaatgaggtgtacagaccttgtaacttatctcaattcttttggtggtaggaaaagcgcacataaggaatgacatttgcaggtctagtgaggagagacattaaaaaataattccaggccaatggaggccaaaacatttgatttagattttataagaacttacttattagtccaatatttgtcaattacaatgcattgttacttgttagtccaatatttgtcaatttccattgcatgtattccattttaatacttcatgattatttttaccgttatccttatctgtaaccatagcttgcaagtgcataataacctacttgatgaattccagcaacacactttccaatacactttgtaccacgtattaaaattcacgcgagtcttagtaaataaaaaatgggactcattaaataggagatgaagcctacatgaatatcatccaatagaaggaagtgtcttcaaaagagtataaagagcatattgctaacatctctctaacttaccataaatttgacaattatacatgaatatagttcacttttatacctcataataaaaaataaaaaaaatccagaataaaaatgaaatcaaaagtgcaaatgttaagaaagagagaagaaaacagcttacccatggttgatgcaatcatagatgaaaggagacctaaaacacaggagaatggtaatgaaatggcaagagcacgaggtcccaaatctgaaacctggtaaactagaaaccattgtgtcagacacacttatatttcatacaaaacagtagttataaagttggcttggtggttaaagggagaaggggggagggagaggttgtgggttcaaatccctcccactaacaaaaactaacaaactaacaactaacagttaattgttaacaaaggaaaacaaaactagaaaaaataaatgaagcatatacagcattatccaagggctctcatataaacagtattagtaaacatggccttctagtactaaataggcaaagaaatagtatctccctttattccccagaacacaggtacaaaaatgtattccatgaataaattaatgagtaaattgaacaaaataataaaatacaaagaaagccatttgtttaaatttggacctacaaactgcctaaattataaagcacttttcccactccttcagcactaattttaaacttaaaacaagtgatcttttgcctttttaagatacagataggatttgcttcttacaaaaaacagaaaactatttttatttttttaagaaaaagcaatttagagaaacacaaaaaaagcatacgactgcttattttattaaaaaaatattttttttaaaataacttttaacaaatgggccctaagtatgtgttccctgttcttatgccctaaataaaataaaataaaatccttcatctgtaaactgagaaaatcgctatactcccagtagatgaggttatattttcagaattacatactaacaactacagattggtcaaaataatctttcagaggcaagtttctcatgtagatggcactgtaacaattggatgcaataagcccaaaatcataacttgatgtaagcagcagttagccagttaccataaacttcagcacagatacaaagaaaaacataccagtagttgctctagaaaacaaaagtacgcaagcatgctgaccaagataagtactggtacatcctgccagatcctgttatgcatgaaatagatagaatacattacaattagaaaagtagtgattggctgatgatttatcataggttttgtagacataagaagggtgatgtttatgtctttttaggaggggtatcttaggtagatatacaaagagattgtaatgtgttacattacatgtatcatgttcttagtttttctctttattccctttcatttttggtttagtttttcaggatttatttattatcctctaggttttgacatgtctttttttattaaatgattctttgtttatccaaaaaaaaaaaagcagatgtatatgttgttcaaaatcagaatcaactgcatgtctattagacagcccatcagccaatagcttatggagtaggcttttcagtgtgtttgatgggccttggattttcccccataaccaggaacagtttcttgagattaattcaaaaaatttggcaggagcagagggtaaagttttacaggtgtcttgtacactgtcatttgggtcttaggatggagaagagatgcttggttattcaaggtaaatatcattcaacttgatgtagaacattattgttctgatggcatcttattggagttcagcacatcgattcttccaagggggttgcttagacggatataaaaagggattggatagctctcttattttctttggtaaagtgaaagaaggaaatctattctttgtaatcttttccttatattctttcttttccttaaaaggaacaaaaaggatgccaaacaataccaagaggcaagagcacatcttactgccacagtgccacctacccatatgtgcaaataaactgaaactgaagctttttaaacttaacaacccaaaatagttaagatctactactttatatagttttataaccagcctggttgccctaatatcatatcatagataacactttaagtctcctctatgtcagtttaagtgttaattgaacacagatgactaacacagtgaagtaattaaacatacctgtaataaactatttctgactgttgtggcacatttgatgcctgcctagcaagagtttgaggattataaattttcaacagtgttactgggaggttctggacatcctgcttgcagacatcacaggtcctgtttcccttaatactaaaccactttactgcacattcttggtgagcaagtgcaagatcacctttacaactgcattccatcttaagtgtattccctccttccccaagctccaccaaacaaatcctgcaaactgcttgttcctctggaatatcctcagtagcatcttcaatggctggaaaggaaagaacagagtgaaaagacacaaaggagggggaggaggagggatttaagcattcggttaacaagataatacaagccaatgagaacagtatactgattaaaaaatttatgtattctatgaaaaattctagtccctatttaacctgtttctatttaaataccaagtaatcctaactcagaaaaagacaaaccataaactaaaaccctaagatcaaaattgagaatcaaaattagaagttaacatcaatataaacttcattcagtattatcatttctttatttaatttggagagtccactgcaatgaaatgaaagggttttctttagattatctctaggaaacctctattctctttcttctatattattgttgctaatttcatttaatttatggtttagtgctcaactcaataataaatacatgttgcttgtcaaaatgacagaacatttcaaattatgcacattgttgatcaagttcaagaagtttaaaagggacatttagaagaaaattttgtaaattccatatattgaggaattaccaatctctggaaggaaagcaccatcagttaactttccaccaacagtttcaagatgtcgttttgccgaaattacacgaatcaagcccctagaatctgtaacccttaaattagtggctctgccattaactgggactgaaaatgatcgtgtcatatgctgatgaacttccattgtctgttcaaaaagaaaaggcatatattaagcaacatgtgccatttttcacttacaaaatgtgaataataagtacagtgtaaaagtagttgttttggtcttgaaactagaatgaacactggaaacatacacttaaatcagaatcacgtcctagatgtcttccatgtccattctctacacctgaagttgcaaatggagtaactggtaatgaatgtgaaacttttgttaatggggagataaccctattattaagagacagaggagttgaagtggaaggtttgtccaaaggagcatctgatgggggagtgttaggaactatgagacctgtcctttcaatatcctgggaacaggtatttatcttgaagctcctatgaggaagtaaacctctcattgaagacctgactttggctgaatttggccttggggggagtcctcttgtggaaccaggacttgatcgtgaaaccaaaggaccatcagtctttgcaaaagtagataatgcaatatctagggaccatgctggtatttgcagtgaggataaattaggtcgtctggactgaggaatctgggagtccttgttactcttttcatttccagtacatgtctacaatgccatgccatcaaagtaaaaaattcagagctggacatgtttgtattccttttatgatggcatggtgtgataactaataattactttagtctatccagttaatctaaatactaaaacattagtaatctaattctaatcaattggttaaaaaatacagattattggcactgccacacccagacccccacaaaaaataaaaacaagatcttgaatgaaaagaaagcacagaattaatttagtagtcacattacgattattcagatcaaaacaaacccagggtttcatttctttaagaaaatatttagagtaacctggacaggaaccggcacaaaatcggcatcaagttgaagctcagcatcagcaccgtcacctctcttttccatccaaggaaacgctttggcaaaactgttacagtcacggcatcaaatgcccaaacgccataatgtgttatattatatttttatttttatttaattatgattagcattataataatagaagggaaagaggggtgacaatgatgatactgatccgaacaaaggttagggttcctttgattcagataattaattttttaattaaccaaaatcgaaagattattcgcttttttggaatagttatctcacgattattacccgccaactgcaactcgtgacatgccaactttatgatccttccacttctcccacgattctccattctacgtttttcctctttccttcctctgcacctcgctcacacacacttttcttggagtcttcagcctctcaattttttgcaatttttttcctcttttttatattgtttcaaccataatttttttataaaaaaaaaaacataaataaaacgccagtttcctatattttttttattaaatgtaagggctggttttgacctactaaatgtgaaaaactctttttgaaaaataaaatatttatatatctttatattgtaatgtaataaatatttttaataaaaaatattgcttttaatttttaaatacttaaaattaaacggatattaacaaaattgtattttatgtaatttcaaaatattaaagttaagccacatgaaaacaccttcaatataggtcaattgttatttccatatcaaacttataaaagaggtaatgagtcactatagtggtatgacttttttatttaagattttaattaagattaatttaaaattatccttgagatctatgcttaacacaatacatacaatttgaaggatgttttttcggaaagatttgaaagtcattccgttggattcaaggttgatttgatgattgtaggaagaaaaaaaatgtttaaactcatatactaacaaaagaaaattgaaattgtaatttagcattttttataataataaaggttaacttatattttttatctactataatggttatttcttaaatctaatctcttgttttcttttaaattgtacaaaaatgggttaatttagataagttcacataagcatgtggctaataaggtgaattttcaggtacttaaaataattaaacttatttttaatttttactatattaacaaagttatttttacaagttatagaccattggtctacaagctcataaattgtgtggctaattaggttgttacaccttcaattatcgtttcatgtcccattgtattttaaaaagtacaacatgaaatgtaaaattatattccaaaatgcaatgggggacaagaagaaataattagaggtgcagaaagttttagccttagaagtagacaatagttaaatggatgacttgtgtttaagctgaaatgcagaattgtaggccttttcacccccatctggcgagttaaattttattttgaagaaaatggttaatcaattgaggtgattgaggaatataaatatataattgtaagaagagttaaagaatgaaggcaattaaaggaaggtggtaagcaggtggtagaataatgaagcataaagtgaaatattttgatgtttagcgtggaagggaagttgaggaaggtagaggggagtttcttgtatgtagaagttggattagaatttgaagtccagtccactgaattgaaggaagagcccaagtcagccacaaccacaaccacagaagaagtcgcagatacttgacagtgtgtgtgtgtgtgtgtcattcaatattcaatatttcatcccaaagactgcttcctggatgcatcctcaaagaaacacacatgactcatgactcgccaaacaatccacatacatccccccttccctcaatcacacctcattataacatcatcctactcttccctaattaaactccaacattctaaatgatatcaatattttcatttattagtatctcccgtaaatatttaaatgatacacacctatattatatctcatcgatctcatatataatcacactatctcagtaaaaagaagtcatttaatcataataatttgtgtaattaattattttcttaaaatatatgcggtgccgaaatttatttttctattaaatagataaagtttatatgtaaaacatataaaattaaaagttcagaatacaataacaacatttttttattcactacatgaatcacatgttattattgatttccattaaaaaccaaattacgaagaatattatttatgatgactttctatctccatgaagtccttttgatatactactaaaaccatccggtcttgtttcctgtaaactcaccaaaccatcttgaaaaattcagtgtctgcaaaagaaaaaaggttttttttttctttctattaattaaatattattgtctgacacatgaacacgtggtcagtaaatgaagggcgaggatattgcattgcgtttgtaactatgacttatgagttatgacaaggaccaaggtgagcacagtgaagaaggaaccataaataggccaccaatgcacatttttcttcccatgtcattctcattccctccatgagtgctaccatgtctggccctattcctaatgatcactggctccatttctatcaacaaaaccaattcccctcttccgtttccgacgccacaaccgtgacaaccaccgccgcgccggcccagctaagcccagaaggcggagtctcaaagcccattagacggcgttcccgggcctcaaggcgaactcccaccactctgctgaacacggacaccaccaatttccgggccatggtgcaacagttcactggagccccttctgcgcctgatctgtttgggcagccaatccctgtgaacccaaatggcctcatgttggccccttctcagtccctttatcagcaacaaaaccacttagcatacacagatggtggagacaacggtttttttcagagactgagcaacccaacagcaacagctccaaataatgatcgtgctgatgaggttttcgtggaccatggcggccgtttcttcccaacaacttcttcttgaatctttcttgtctgtccaataggaaggagcttttaagtttcttccgacagcgataaattaagcagatatttaggtgctaacttcttgaccaaccctatgtgaaatggaactatatttccagtgtagacagccacctgcacctgtaccacactttttcagctctatcttattttttggccttccttggttgaaatcgaatccagctatgttctttttttctttttctgaatttatgctgtgtcggcgttggcttaagcttttgtttgttttccttttctatttaaatttgtgtatttgttttctatgttaatcttaattgggaccttctctttagggagtcctagcccgattatagttcaattattttggatatggtaactcggtcaggcctgccactacctacaaattcttttacgtgtgttgacttgcttccttctttatatctctctctgtaacaacgttattcacacaataaattttataataatttattttttttatcaaattacttattttattccaaaaatatcaaatcacttatatgatcttttatcttatttttagtttaatttgatcatttgtttttttaaatataatttgattttttttagttcgctttagttaaaaattggttatttatcttaattttttgtttcaattttaaaccaactttttttgttaaaaatgaagtgaaggaaaaagggagaaaattgaaaaaaaaatcattttaaatgataaataaagttaatcttaaataaattaaagatcaaattgaaaagaaaaaaagataaaagatcaaactgaacaaaataataaaataaaaaatcaaattgaaccaaaaaataaaataaatgaataaataatttttttaaaagatagaagactaaaatgagctttgttaaaagataaatgaccaaattgaaataaataaataaaaaagataaatgatcaaataagtcatttaatcttaaaaatgattgttggacactaattaaattattagacacctataagaaagtgatacaaaaaatatatagatatgatatgataaaaagagaaatgatgagtgtcaataacatatattaaatgaattctttgataagagttgacaaaattgattttaaataaaattaattttgattaaaagtgattttgaagtgatatgattaatgtttaaatatttttattttaaatttaagttaaaagtaaaatttagtataattttttattcaatacaaaaattactcaaagttaattcaactcgatgcatatctgcttcaacattatgttgaacttgatccacgtaaacttatggacacaaatttagcatactactcaatcaagtttggattcaaaatcaattataaaaaaaattcaacatgaaaactaaacatgtgaaaaaatacctaaaatcaattatggactcaaaattaatttttaatgtaaaactaaacatgcactaaatgaaatactgtccaaataccattttctattttattatatacttttttattatctcttttgcatgaaagttaatataaatttgtattatatataaatagcattcattatctctctggcctttggtaacgaaaaatgtggaagcaggaagcagccctctctttataatagtaaaatctccatggtgtggaaaaaataaatttatttgaaattaagtagctgttaacaagtgtgtttggacctatttcatctttgagtttaggatgagtcaaacattatttttcagttgacgatgatgtttgatataagaggagtgttaacgacattttttttttgtaatttgttaaaatttattgaaaatcacttattttgataaattttacttcttaattaatgtttctctttcctaaatttattgaaaatttataattttcaataaaatctaaaaagagtgtcactatcttgaattgtgtttcaaattcaagtttaattggaagcaattgaaagtatttttttttttttttgtatgaacactatcttgaattgtgttattttaaacattacatgtcaaaatcaattttcaaatatacgcggaaaaaaatcatacgactgatcttacattaacttaaaatcaattttataaaatcacatgattcaaactaattctaaagacatatatccaattcatgtatgatgcctacaatatgcaaaagatataattgatgacttcaatgggacatgaaaattcacgttagattgtacgagtaagttgtgattttccttcccggagctagcaacgctgaaaaagaaagtagaacccgaaattaagtgaataaaaaggatatggtatttttcccatctaaaattaagcatatgcacaaacaacactttcttgtataccagcattcaacacgcaaaattttgaccacaccagcaaaatgaaagttcccttgtgcaacttcaaatccactatccaacataatgcatataatattacagatatcgcacggacagttgctattgacattctgccgagaacccaacaactccaccgaagtatacctattcttttttctcatctcttccattattttgaggattaagctcatcatcatcataatattcttcaaaatattcttcatcactatcatcctcctcatcataataatactcctcatcatcgtcgtccttatcatccttgccattttgtagacgaagtgtgccatctcttgactgctgacctcttaacctctcttgaattcgatccctaattgctgttccctgtttgtagatccaagtggtaacaataaataaaaaatgagaagttaacaagaagtttacatacattagaagagttgcatagctttttcacataaattagctcaccatcttgtggcaaccttcttcaaacatttccagaaaaccagctacccaacgatcagcattttccacccactcattccgatgcataccagcagtctttgcaacaatttggatctggataaaccacacaaagatatgtatctttaccataattgataattcaattaaaaacaaccgagataatttcaatgtatgatactgttatatattaagtattaagcgtacataaaagttgaaaagagaatacttatgtccacttattatgtaaaaagcataggttttaaaccatagcctcatctatactgctatatacaaagcaaaaaccgtagattagtttcatcactttcaatttaatacaacatctccctcacaccccgatatacattagcaaaatcaataatttaagaaagctgcttcctaataaataaataaataaaaaactacgtaccccaatatccgaaggctccaccctatgtgcaagtaagagggagggatattgtatgcagtcttacccttgcatatgcaaagaagttgtttccggattcgaccccataaccaacaagtcaccaagacacaacttttcttaaagacaaactcagaaagagagagagatgcaaaaatagtatcatttctctatttttcttttacaagacaactacaataaagccagtccatagtttttttcactctctagtatcttttccgtgtaggcaaagaattttaatgttggccaaatattaatatgagcctaataaagtcaaggaaaaaaattgaaacaagaaatatttggaatcagatgtatagctgacaatagagaattatgccaaagcaaactagtaactgactgatatcagtttcatggcaataaatcatacaaccactaattaccagtgaaactgtgatctgtgatgcccgacagtgaaggtttgacaaaaaaatggggagaaattaaaagcaatattttctcattcatccaggtttgtcacactaaaattacaatgataagttaaaactatattgaaaaaaatatatagatataaatttaagaaaaataagaaattcaatctgcaaagttctctctccccccccccctccacccacccacccacccacccttctctaattacacaatagtaatcaaacagcaagaagatccatgaagccaatacatttacttaaatataaaaatatacagaggatatgaaaacaaagacctatatatataatgaaatttagcacaatatgaggaatgcaattttcgagaaggtatattcaattgatttgataatgttaggactccatgattccgaattaaaacagactgcatggttcaaaataacaattaaaacaacatagccatatgtcaattcagattgggttggtttttttgttgattttactccttgataatgtttttgtccttgaaaaagactccgagatccacaaatgcaatacttagacaaaattgtgaagataaaccgttgaatccaaaaaccagtagcagatgcccaatgtcccataacagtttgaatgacaattgtacttaactatgaatttttcaaagcactttacctgacattcttagctcctacttcaacagtcgttacattacaaatttacaatctacatgtgattttcatcctacagccctttcatcccatttaattcacatgatgttgcctaacaaaagtattaattcgacttgattacctaaattatatgttatagcaatacataccttttcgccaactttttcttgatgttccttcactttctcttgtaatgttttcaaccttctattcaccctcagtcgcttttcctatttatgacaaagtaatgacaaccacaagggacaagagcattcaccaaaggaacaaagagtggcgtcaatataaggtcaaacaatttgctgaaagacgtatcatgttaaattttaaagtagaatacatcaaagagatctatgtcaaatcatgccttcacatagctcacgccaagctcgtttcttgagtacccacgatccaagttccgcagcacatattggttataatctttgacaattctcattataacatctgacgtggatattccttcggtccgttttgtttccttaaacctcccaacagatttaacctacatacaaaattcacggcacatagtataagtcagaggagaaagtaacaacgaaataaaaaaataaaaaaagttttgccatacatacaaattcataaacatcattggcagcaccactggcatcagcataactgtggacaacgggttgacaaggggaaaaaagatgattatattatgcaatgaagttactagattcagatgttgatgttgagagattaatcttacggaagagagtcatgagccacataatcaatgttgttcttgtcaagaaactcttgattgataacccaaggggcatcaggaataacttcatccacccatctgatctcaaaatgaaatcaaactcaaattcaaattcaaattcaaatggttgaagcaacaacaacaaacaaaatatcatacttgcagtggcgcagggattcgtatcgttcggcctctgtcataacagttttgcctttgtatttgtgggtgacttcatcgttgcaacacccaacaagcaagtatgtattcggaaacctaaaatcccaaagtaagagtgtctgtgaatggaaccttgaagaaatgacttctattaattaatggattgatataaatgaaatctattatcagatctcggaggcaaagcgaaggatcaaatatcatatgaggattaggaaatgattgatgcatacgatttcttggcttgctcaagggagcgagcgtggccaaagtggaagagatcgtagatgccatccgcgtacacccgaacgggacgctcctgctcctccggaggcgacgccgttttcgaatgctcgctctgatctgccattcgcctcttctattctcttctccttcgctccgcctctctttttttcttctctttggtaataaataaatcgcaatttcgctcgcaaacgtcctatgcgctttttcttcactgttttcctccgaaatgttctttttcttaaaacgaagacgaagaagagtactaaacgattgtttcagagtaaactatgtttttctcttataaaaaatgctttttcattttcatgattttgttccttcaactttttaaagacttcgttcttcaacaatttttattgatatcaaaataggccgaatctggtgagccataagtaagttatgttttctaaactcagcatatttttaatatattcagtatattttttatttacaattttatccttatacggattatcaatctgtataaatcatatggattgattatcaatataactcatacgaattggtaattcgtagtcatacagattgtcaattcgtaaacattcaacacaaacggatgagaaaaaactcaaggcagagaagacaaaaatcaatgaaagcaacgacgaatgacgaaatagcagacgaaccacgacgttgggtgcacgaacgaatggtgaaggtggagaagaaggagaacattgcgcaaacaaaaacagacaagaggagaagaagaaaaagctaaatggtgtatgtccatttttacaaagggtatttttgaaaattaactgtacaatgctaaatgtattgaaaatatgctgggtgtagaaagcataacccgcctagatgaaaaattaattttttttgcaatgtgatgaaattgtaattcggctcacttaacccatgatgtttagacaattgaatttgattttaagactttggtattgtaagatttttgaatgatatttaggaatttaagacatttgaattattacttgaatgataatattatatgtttgaatgattatttgagacatttgcctattatttgcattcgtatttgaaccatttgaattaataaatgtcgttgatgaaaaaattattttaaaaaaatgaaaaatgttataattttttatttagaatttactttttatttttataaatttggtgagtcaacctatctaatccattaattcatagtgaatcatgtcaagttgatattttcatgactcatttaaatatgagttaaattaattcggttatttaacactcaacttatgatagatcaatctatattcatcacacttatttgacacttctactttttttatttccaatgtttagatcattttcatttattccatagttaaatgatgatatgttatttatttttattataattcattttttggcaactcaaacgctaggataactttttaaagattataaacatattctatgggcaagaaattcttatatctcaaatccaaatccaacatttatacaatttcaaatccagattgaaagtttgaaacacaaaaataaaataaaaacaattcttcaccacttctaaactttttctccctatctttactcccaattcttcacaacttcacttctccctctcgtcctacccctctcctcctaccaccatcgtttttcttatttttttatttatttactagttaaagatgttaaaataaagaaaatcctaaaaatatttcaaaaatctagaacaaataagaaaaacacaaaattcacattttttttattcttcactcaagaagtgttctcatccgccactggtatcacgttggcgtatcccacatcatcaattacttttattattataaaaatgaagattttatagtaatttaattaccataattgaggatgagtttgtttaaattttaaaaataacaactttaaaattggtatttaaaaaaaaatctaaaacttaactaatttttttatctttatattaatattctaattattcgtatacttatcataattccttgataacaattaacttataattactgctatcatgatttaattatttataatttcaaattaaattgataataattaatctaaggttaatagctgcacaggtcttcttgtttgggaatgttttggttggcagtttctttctcaaaagttttttctgatgttattctatatgaatttggttttcaggattcattggtggagactgctcaagaggaaaccagttcattaagtaatataattgcgcaaaccactaagtgatgagatcctattatatagggtttgtttggattggtgttagttccatccaacaccaatcttttgatactgccatcccgttgaatgtgcatcggaatgtacgatttcagtaaaacaaacacactcatagttgttgccatttttttttgggcatgatgcttggtgtgattgatggacttttcctgttatatagtttatgtctaagccccatttttattgctgttacgttgaatgttcgattttttatctccttgattctttcttttttgttttttgtacaatagaaaagaaaaacataaactaagttttaacaggaaattttgatcttcttgatctgaattccattttctgaaggttggcaatttcaggtttgtgtacgcgtgaccgacctgtctattactggtaatctgtatgtttgaggaatacttttgctttgtactttgaaattgaaatcctgtgcttgtcaatttaatcttttgtttttgagttgttagtcttgaatgatgactgcataatatatgcatttggatcacagcgacaattcaaaaaatatatttttttaaatggaagtagcaattgttagtttttagattaatgtgatgtatattttttaaggtagagatctgtacagcgtcagtaagttaaatttagattataataatttttgttgtaaaataaaaaaatgtttaaggaatgttggtcaatttaggtgttggcgtagaaggggttcggctttgttacctagtgtaatttattatattgggtaatagtatttgtacatcataatatttgacattattttaataggtttttatggtaaatagttatttttgtttttaaaagtatgtgatgttaataaattagtattagtcagttcgcttatatggcatgtaaggatgaaagtgtcacgaaagaattatcacgtggacatagagactaatttgttagtaatgattttttttattgcttctccttttgattgttagacttgcaatgactatttttttccctctatcttatatattgttctccaagaatgaaggactgagcttcttgttcttcctctctaggtgtttttttttttttatctcaccttcattcatttaagttactgacaaatacgtcattaaattaaataatttattgacatttttgtctttctaagatatacaaaaacgacagcttcgtcttcagtggaggaagaatggtgctccttcacggtagtcatggaagtcgtcagaagtctcaaaaggcgagaaggggaaggtgaaaagagaaaatgtaacaaattaagggtaaatgaccttgtgttttgagtttgactcaagtagtaacacaagaaaaaattatattgacattttagtcctacgagtcatcgtctcaggttcaaccaatgaatgtcatgtgagcaattatttcgtgacatttttgtccttacgagctacgtaggtgaattctctaatgttaatggatgaaagttgacggtggaatgaatttttctcacttttacattttcaggaactaacttttgtatttttaacattcaggaataaatttgttagcgctaaacacttttaaagataaaaatgataatttatccatatttttatttcatggaagaaaaatattaaaagaatatggtaaatatcattgtgattcttacatcagtcacaaaaattaatttttaacgaagaagtgtgttaataacattgttgttaaaaaaataaaaaagaatattataattaagatcatgtgtaaagcatattctgtttagttaactaatattctcttacgttttggaaagcgacttatactgtggttagtctagagtggaagcacaatctccacatatgtcaattcacgtgcagtccaaataacacttattgaggacagccaacgcacatgtccacatatgccaatgtcacaggctgataggtgatagcggttcatgataaaatgatgcgttccataagttgtttttttgttgacaccccaatcagcatagattttgatttagacatgcaatatttcccgacaaattcacgttctataaagaaaagaatttatttaatctccaaatattattatttcattacgtagtcacgaagatgaaggaagatggccgagtggtgttaatttattccttccttgccaagcttatgatcaaccgcgatgaccgtatctggatcagtgtgttgcagtgttggtaatgaaactatataccatttgacaccacaagtgctgcttacacgacaggtagccatgtatgaatatttctcctgatcatagtcacgaagatcataaaagatatttctcgaagccctctcctttcatcccggcgctggatttatatttaagaggaaaaaggaagaaaaacaatcaacaacagcatatgacatgcaatgtacttaatttcaattgaaaaaaaaatatatagtgaatacattagctacttaaacatgacagaaggcatccgtctaatttacatgtgatacaaaccatagattaaaatagcggcgttttagtgcgctatctcgcttcaacagcgggttgcggcacccagccgctacttctatgctgcaacgcgacggttttcggaggcggcgttgcgtgtggcagatcttgtggcactatcgcaccgctatttccatggaagagaaaaaattgcaaagctttagccatcgggggcagtgttttgaaaattaaagataggttaagggttgcagagaagacgagttgcagagctcctttgccgttgcctcgtcaaatccatacgctggcgccgtcggcccctcaccgcccgattgccgcgaccaagggagtaccacttgtcgcggtaggcgtcaatgagggcgagggtttcatcgggggaccagcacgacggagggagatggcgggaggagggtggtgcagggatggggacgagggcgaggggaacggcagtggggggatcgggaggagggggagaggaggccatgggagagagggttgagggaaagtgggtgtggcctatgggtatggatcgaggaagaacgaaagagaagataataatgcgatgaggcttatcactgacacaatattgagagaaagtgggtgtggcatgtgggttttggtaaatggtttatcattgcaatctccacttcctctgtcaatgtcaacactcatttttattcaccatttaaagcaaaatattttttcctattttttattcattttaatgttatactaaacatttttttaagagattaaataaaagtaatgtttataaacaagaaaattattatatagagaaataaatcttttaatatgaaggtacaattaaataaatattaataatatattaatattaataaaaaaaatatttttatttatttattttagagttaataagcttgtttattttaaaaattattaataatatatcaatattaataaaaaatataagtattatacttttcattcctcatttcttcctatttttgggtaatttcttaacttataacatttatatatgtaatataatttattataagtatttttaatagatttcacagtagcagttttaccgctacccgctataccgcttagcgtttttgaggtcgactgctactgacagctacccgctatttaaaactatgatacagactaaactggaaatgaaattctctaaaataggaccattgtgcatgaaaactggctggtctcgttttgtaagccaaataatgctaatgagatcctatcccacatgctttccaatatatctaccactacagttacaatgcttgaaaaataaaatcaaactatttgagaaaccgcctatcagaggaatgcttaggggtaagactcaataataatcatagttgcaagtttgccttataacaccacaattccaagagtcttgaataaatgcatcatcaacctcacagacttcttcatgagataacatctccactatcacacaaaacacttttgctcttaattgttcggtttcagttttatcaaacaagccccaagagttcaagactacagccaaattatgtaaaaaaggctgagctggagaattatacctcaatataacagtaatcatcacaccatttcttgtatcaggagtaaaaggtaggatgaaacttgtgacactattcaactgtacatgaattgaatgagttgttcatcactgaaagaagtgtttcaaatgaatgaacaataacagttctagtcatgtatgtgtacactggatgaacttatgctggtcgtgaaactatcattggttataatcaatcctatgactgctgtgtaacaacgaaccaaactcaattttttgaaagctgcccactgcagagcaaccaacagctcactttgataatatttgtcataacacattcatttcagtcactagattccaaaatcctatttaaattggaattgttgcgtggcttataaccagcatccttcatgtccatagtcaatttgtccaagatataatatatctcaccactttgagggtgcttctcacctctggatacaaagaagttcacatgcccagcaatctcaacccaactacatcccatttccttttgcaaacctttttccttcatctgatttctcacactatcaacattttcccactctccttcctctgcatagatatttgagagcaaaacatgatatccaccaatccttttatctgtttccatactaagcaacttttcagcaataaattttcccaattcaaagtacccatgatttctgcaagccccaagaatagatccccagatttctattgcattaccatcctcacccaatctctggacaaactcataggcttggaccaccctcccaaccctacctaacatgtctgcaacacaacaataatgttcaattgagggcttaattttatgtactttgtccatatactcaaatacgtgaagaccttcttcaaccaaaccactataactgcaagcagacaaaatggcaacaaaagtaactgcatcaggcttaatccaacatctcagcatcgaatcatacaaggcaacagcttccttacccattccatgctgaccatagctcattatcattgtggtgtatgtgacagaattcctctctggtgttctgataaaaacattttcggcataactgattgcacccaatttggaatacgtgtccactaaagcagttcccacaaaaacattttcgtccaagaaatgatgtatggcaaatccatgaagttgcctagcaaaggtcgtacttcccattgaactacaagctgggagaatcgaggctaaggtcactgcatttggtattaccttgtgaactaatgcctctctaagaatgagaatgactttgtcactgagcccgttctgtgtataaccagcaatcatagcattccatgtggccagatctctatcacttgggcagttctgctcaaataacaactcagaagtcctaatcaacctggatttcgcatacatatgaatcagataactctccataccctcaaactgtatcccgtggcgaattaggtatgcatgggtttgccttccaatgtaagagctcctcatgttggaagccgcagaaagaagggccatcatggtaacggaatcgattggaaacttctgcttctgcatctcgcacacaagcatgagtgcttcctcatccaaaccattctgtacgaaggaagaaattatagtattccacgaaacagcatccctttgagacatgttatcaaaaaccttaaaggaagtgtcaacaaaattgcatctggagtacataaccatgatagcattgacaacaataacgggagtaactgccaatttttttagaacaaatgcatgtagctgatgagccgatttaatttgctgcagcagcgaaagagcagagataacggacagaaaagtgacctcatcgcacacggcctcctctgactccagggctcgaacgaaaacatcaaccccttgaagaggacagttattttgaacataaccaccaatcatggtattccaaacctctgtattttttatggagcaacggtcaaaaaccatcctagcatagtctaagcaaccaagattagcaaacataacgattgcggagctaacagcaaagacgtcattgacatagtcagcaccaaatttaagaagcaaggcataaaacataagagcggttttaggatcagggacagcggggaagacattgacgaaagtaacgggcgacggagtaatggaagttttaatgagggttgcgaaggcgcgaagtgagtgaaggtgtctgtgggttttgacgaatcatgaaatcaaggtgttccaagcgacgacgtttcgtttgggttgggcataaaggagaaaactttgaggacgtagtcgtgttgggattgggggggcaagcaggaggagtacatgttcaagagggagttgtagacgattcgagagttggatggggagcgaagaaaatgggaatgaagggccttaccggcagtgaggttttgggttagggcgcaggccttgagggtggaagagaaggtgtagcaatcggaaggggtgtcgggggtggacttcatttcagcgtagagctggagggcttccaacggcatgtggttgcagatgaagccgatgatgacggtgttccacacagcggtggaggcgcgtggaagagtgtccagaagatggcgtgccacgtgaggttgtccctgttggcacagtttgcttaggcgagaccgaatgctaacgccgcggcttggctttccgccctcaacttgaacaggaggaacaggaacaaccgtagaagccatgaccctcatcctattgctatttccttttgttgtcacactcacatcattacctcttctatccatataattacagtaaaattgtcctactacttcatcaattctaattataggatcacaatagaatgtttataactactaaaagagaaatatattgtaattataaggataaaatggataataaacctaaacaaataagagtataataatcatacatccacaatgtaaaagtttttttttttttttttatattatcaaacaattaaaaatcattatcaatataacttttacaatgattattgtaaaatttaataaagttatcacacactattttattttattatttattgatttacttaaaaaaatattgacacccattagaatacatttgttatattttactccctccagacttaattaaaaaaggaaaaaaaaaaggattgatgaaagcaaattttaactatttgcatcctatttaataatatcatcttaaaaataatttttaattaattgaaattttaatcgaagattattttttattcttaatattaaattaaaaagacacttaaaaaatagtttttaaattttaatactaattccgatcctttacataaaaacaaatcataatatttttttcctaattatagaatgaaacatattattgttttgaaatgtattaataattgatatccttggtcttgatttattgtgaaatataatattgagatattattatttttgcgtgaaagtaaatgcatttatcaaactattaacattatatctcatactcattatttcttaaattattagtaatgttgttatatacaatcgtcactttaaactaattagttctataagcatatttaaaataaattttaaatttattaattaaaattaatttatctattttcatttattttgacgaattaaatattttttatttatttatagaactgaatgtattattaattaactaaaaataaattaattttgtttatatttgagtttgacaaaagtataagtaaaaaaaaatagaataaaaaacgtagtccaaacacttgaaaaggtaaaaacttaaaataaaaataattaaaaccatacctaaacatgtaaaaaaaatcatacctaaactaaaatattaaaattttaattattttcatcctccgttgattagtatcgagccccgagaaagtaggaaggagaagggtgtgtgactgtgtgacagtgtgagtgtgagaataaagaaaagaagagaagattgcatttgcatcaaattgaagaagatggaaatgcagcaactcctcagtatgggcttcccggacgagttagccgcccaagccttggctgccaccggcggcaaatccaccgtcaaagccaccgaatggattctctctcagaaacccaactcttccacattccagcccaagctcgatcgcttcttccattcccagtcacaatcacaagaacatgacgaaccctccaagcgccccaaaccttctccttctccttctccttctccaccacaaccacaacactcgccctctttcttctttaagatcgcagacaagaaacacgccaacagccacattcacgaacccttgtacgagcggttgcgtcccagaacccttgacgacgtcgtaggtcaggagcatctcctcgctcccaactcccttcttcgctccgcaatccaacgcaaccgcctcccctccatcctcctctggggcccacccggcaccggcaagaccactatcgccaaagccatcgtcaactccaccccttctattaactcttaccgcttcgtctccttatctgccgtcaccagcggcgtcaaagacgtcagggacgccgtcgacgaggccagaaaactcagactcaaatccaaccaacccaccgttctcttcgtggacgaggttcacaggttcaacaagtcccaacaggactctttcttacccgtcattgaagatggcagcattgtcttccttggggccaccaccgaaaacccttctttccatttgatcacccctctcttgtctcgttgccgcgtactcactcttaaccctctccaaccccatcaccttgccttgcttctaaaccgcgctgtcactcacactgaccaagggttgatgcagagcgtgggggttcatgttgatgtgagcgaggaagttgttgatttcataagcaacaactgtgatggggatgctcgggtggccttgaatgccttggagattgcagctgttaccgcggctgcaaggctacaacaagggatggaattggatcttcacacgaacgaggaatgcaaggatgctgctgctgctgctgctgctgctgttgttgttagtgttgctgatgcaaaggaggcacttcagtgcaagcatgttgcttatgataaagctggggaagagcactataatgtaatcagtgcgttgcacaagtctatgaggggaagtgatgcaaatgcagctatttattggttggcaagaatgttagagggaggtgaagagcctctttacattgcacgcagactcatacggtttgcaagtgaggatgttggtctggctgatccattggctcttaatcaggcagtctcatgctaccaagcatgccacttcataggaatgccagaatgcaatgtcattcttgctcagtgtgttgcttacttggccttggcacctaagtctgttgctgtttatcgagccataggagccgctcagaaggcagtgagggaatccgcgggacagaatgagggtgtgcctctccatttgaggaatgctccaaccaaattaatgaaggacattggatatgggaagggatacatctacactcccgacaatcccaccgcaacacaaacttacttgccaccatcacttctgggccacaagttcctcgattggcctgagtgacagatacggagttattatgtctttttttttttttttttttttttttgccttttggttttggggtagtaaggagaagggtgcatgctgcattgcaaacgatgtgtgcttctttgtatatttttccaccattgctaagaaatatattgacaatggtgggggtgggggaatgctaaatgctagtgcaatgcatgatgtaaattttgacccaattaaatctcattttcactaatttacttttgaattttattttattcttcaccataggccatacctatcactttatgaaatatttaatttaataattgttcgatgagttcattaaaagtggatgtatgtggcaaattaaaggatcttacattcagcaattgcgcacagatttttcagtaaaaaatatgatatcaccttcaacagaattaccaatttactagtctgaggtgtgcaatactggcattaaagaagctgccttttgttttcttacataggattgaggagttacttgtagaaagaacaatggttggcagtaggtatactacagacgcatcctagacatttgtaattttctgcattttcacgctttaaacggatgactctagcaaaacacgtgatttacaatccacctagtacaacaagctaacattctgactcatcataacaagcacttgatagttgatatacaccgaaaaaagaaacaagctctcttattattaaattaaaaagctgacaaattgggggtcaactgatgaattagatccattccttggggttgatgcatgcgtccaagagtttccattcttcgcttccttcttctggtttctgcatacaaaaggtcaccaacatttcagtagcaatttcataaatggaaaatttaagtcatctaacatccaacttgtttaaaataaagaagattccaaaatcgtacatgatcgtattcccaccgagcagtcagtgggagagaaacaagtatactttctattctccctccagttttcagtccaaatgttgtacccctatcatatacctgtggccaaaaatgttatataatacaaatctgatttgaaagagcagagcaatacattttaagtctaaagttgggttaaaaggtgtaccaaattgaattcaacatatcgtccccttcgcaattgttgccatgctttctgatgatcattgaagggcaaatccttccttttctctatgataggtaaataagcaggaataacagaatttgcacattctgcaagcaaccattgtttgggcagcatgagatagagagaattatatgtctttccagtgagaaccatcagatttataaatgcaagtaattaccagtagcaaaggaaaggagcatctcctgatcatagtcattaagatcatcaaaaaatattcctccaagccctcgcctttcacctcgatgctgaatgtaagaaataagaggaagataaggaaaaacaaccaacaacagcatatgcccatgcactcaacttcaatttaaaaaatatgtataatgaatccactctaaccccttaaacataaaagatggcctccatggcccatcaaattacgtgttatattgactcaactccggtatactcaaacgggagcactgtctatgacaactgacaaacaagagactgaaaacagattaacaattttaaaccttccgacaacatcttcctagtaatcctcctatttataagatgaagaaagtatcaaatgtttcttatgtgttaaggacactaagtagttggcataaagaagataagatagggtaagctatcatatcctattttaatctattgtttggtgagtcgattagatatgataaacttattctattcctatttgttcatcatatcttattcattaattcgaaaattatcctaaggggagagtaagattctgaacaaataagattacatagataaaatttcccttttcaccttcatctcacagtgtgcaactcctttgttccaccaccatcaccaccacaacactgtccgatgtcactgtagccagcataatcgccatgatcaccaccactaccaccacgatcataattgcatagtcatcatcttgcttcccctgcatcacatatcttcttcccattcccatcatttcattattactgacagtcattgctgttacccatttaccaccatttgtttcttgcttattaattatgacagcctccaattcatcatatattaaattcatcaaaattaaatataacagaaagccaaattcatgagtaaacttctattaaaggtacatgaactggacatggaatgcttaatactcactcatcactgttaacctttagactttagttttatcaaacagatcctaagactgctaaaaattacagtattaaaagcttcattgtgggaaaaaggattaagaattataccttgatataaaagtaatcatcacaccatttcttgaatcgggggtaaaacgtaggttcgaacttgtcacaggtttgtttttgaatctacataagaagcatgatttaaagtaagagagattttaagtgccttgattgcaaaatccttaagcatttgccaaaacctttcatagaaatataaagagaaacaaattcggtgcttaacatttcaatgcctccaattttaaatgaaccaagatacataaattcaactaaagaaaacccacctaaaactacaaaaatatattaaaggtactctcaaaaaggaccaaaatcatcaaggtgtggtgacattttagaacaaaggaaattgatttttttctttcatcttttaccaagtaaaaaagccattattggttctaaaccataaaaatgtcagaagccaatacttgtgctaagcacatactgaatggaagtgcttaacatcctcctcaaaaatgtaagctggtgtcaagtcagttcccccaccaaaccaccattgtctaggtgctccaggagcatctgcagaaagcaacagcttgactatcaatagcagcatatttaaaaaaggattcaacaactttatgctcttatgttaacatctctttggtttaatatttgttttaagattttgagacgaacatatagatatagttgtgtttttgtttttttgtttttatttatatatatatagttgtgatttaatcataagcaactgataacaaatagtaatttgaaaagaaaaaaaaaacctacaaagttgaacccgaggtaaccaagcttgaaaaagacggagcagatatcagatcatattagcttctatacagtaatgaaagattaaacagtcccaagcacacaaacaaagcccaaacaacaggaagcaaaaagacaggcatgaaagaagcagtataaaaagaaattgtgaatcacatcacatgagttgaaagtaatatgacaaaaaatactgctaaaatgataaaaagaggagcttggaaatgagcaaagcaaaatgtaatttacctttaggagcatcggtttcaaaatagcgatagttgaaatgtagtgtaggggcaaacgggttctttggatgtaaaacctgaacagaaagacaatgagggaaaattaattagtccaagaaaaaaaggcaataaaaaaaaatgagttgagatggtagagagatactaacagagctgattccagcagcgaagaaaggcacaggaccaggtttttgatcggtaggagcacccttggcagcacgatatgcgtcaggtggcatgacaccgtaaacaacagagacattaaccccagccttctcccaaacggcaccgtcttgaaggaccctgctaatgccaccgccgccaccgggcctggaccaaacgtcctccttgaacttggccccaccatcagcggcctcgagggcactgcaaacggtgtcctgggcctcccttatcatcttctcgaagcgggcccgaaccgaagtggaagactgggcctcgtccactcctctgagaaacgtatccggacgctgggcctccggggtctctttctctatcgaaagggtggctcgcactaggccttttctcattggaggtggcttccaacggcgatgagtgagcgagatcgtagttggagtgatacaagtagcggaagcggagctagagcgaaaagggaacgcgtaggacggagctgagacaatgctcgcacaaggcattatgcttcggattggatttccgacactccaatttgattcgatataagctctgaaaatgaaattcccagatgataaggtcttccttcctttcaaatacttgcagttataaataaataaataaattattttaattttacttttgccacttggtatttatctggggacaaaagggagaagaaagcatggaaatccaatcaacctcttacgttggtttggatgtgcaattctaccttgtttttgtcttctcgatttatgcagaatacaggagttgactatttaatttacataaacggctttactaaaattaaatacagtacattttatttaccaccaagcgacgcggtaaactcttatcttggatttttttttatttataatcataattatctctacttcaatgggtataattcagcgagcagtaacaatatcatgagtgatattagttttgggtccaataaagtagaagatgtctgtggtcagaccaaaaaatagtaaaatccaaatatgattagatatttaaaaaatccgtgtttaaataaatataccaattaatacatggattaaaaaagttgttgggatttaactccttccttagctatgacatctacattatatgttaattatatgttagtccaatagttttttattgcattcccaattatagtaatgatatgaaggtgtttcggcttagttctaaacaagttatctatttttttctctctttttctggccttagtgggatcttcggtctcctattctggtatggaatgaagtacctgtacaaagaatttcgacaatcaactcagttagatcgaaggtttttctaatttaagtttttcattattttttaatttacaaaataaataatggtctttaatattagtaaaaaatatataaaaaatataaaaaagattaaataaaatcatatctaaaaatataaaaagattaaataaaactaaaaaataaaaatacatttatttattaaataattaaattaaaaaattatttaaattatttgaaaaaaaacaaactaagtatataaataaataaataaaattacgactttttgaaatcataaaaaaaactttagtttacgattttgaaatcttaaatcagataaaaaatatcaaatcgaagtcattattttagttttaaaaaaattatacaactttaatgtcattatttttttaaaaaaataattaaaataaaaaaataattaaaattataaaatcataaaataattaaaaaataattatacaacttcaattttaaatatatatatatatatatatataagttaattatgacttttaattaagaagtaaacctcttgcggctgctacctgtttcacataatagtagcctccaattggggtggcagaagcgatggcattttgatggagtatagagctgggagcgcaactgttattgtttagagattgcaaatggttggaagcaaaaaaatttgccccctaaatcttattttattttagttgtatctttgagaaatttctattaaaatcatgtatgcaaatccttttttccttataaaacctgaataaatatttttttaatcaatcaaacaaattttaattatttctaaaaattatcattttcagaatttattatttaacaataaaattcataattttcaacaaccatgatttttttggcataaaaaataactgtcaaatgccctccaaaagtgtagtatcattctctcattagatttaagtctcttttgttcttttgtttgtttctatagaaattgaatccacacaaatattaaaaggaataaaatataaatatcaaattaatattgtggggagaagaaaaataaagagagatgttttattttcttgtactgaaaaaaatcccctaaattggaatgaaataaaataacattatttcattgttttctaatctaaaaataataaataatttaattctaaaaataataaataatttaatttttaaaatatttttcatatattttttttatttccactattcttataactcaaaataaataaggatgttcatgattataagtcatttgctattttaacttagtcaaatatttgggttggattttttttgagtgtttaggtcaaacttaatccaactcattcatgtttaaagtagatcatgagttttagttttaaaaatgtgaactttatttgttggttcggttgattaataaaaaataataactatatatgtatatatttaaattaaaaaaatattattattagtgataacaaccctgtaaagttctttaagtatgtattgtgtaatggtaaacaaatttttaaggacaggatgaaagttcaggtcccacatgatgttgcaaatcaattgaataatgtaggtgcaaatattagaattgtcgtgtgtttggttgaattttgaagtgttgaattgtaatagaatggggacctagatttgtgtaatatgtatgattgtttctgtctatattatttatttaaaactacattgaaatttaaaataaatttaaatttttcatcattaatcaaacttaaattaacccatttgcaacttgattcaatttgaattggattaaagaaatatatacaaatccaatttagtacctaaaattaatatctaaaggttgatttggattgaatcatgaattcagtgacatccaaccccaattaataaacacccctacaaataagaggagaaaaagcttttaacttgttttttattcctaataatacatgtttttctttcaatttcacttttttttttgttctctttatttcacttttgtaatgtacttatttatcaaggtaggtaaatgtaaggactttgatttcagaaccttatatatatatatatatatatataattttaattaattttttgttaataaaagatttttaatgttaaaacagtactctaaaaaaggtcggaaaaggaaaaatgaaattgtaaaatgtcaaaagtaccccgggtctaggtttttctctctcgtccaccgccacgccactcttcactcgcagattcaaacgtttccgaggtgaggctgaggcatctctctctctctctctctctctctctctctctctgttttctaggtatgtgtggttcgtcaatttgaatttactttcaggtaactcttagagttggattttgagtttgggcgaagattcatttccgttaccattattctcccatgccatgcaaccttctctgcttttgctaacatttttgcttttgttttttgtagaatgggagctgggcgtgaagtctccatctcacttgatggggtgagggacaagaaccttatgcagctcaaaaagctcaatctcgctcttttccctgttcgctacaatgacaaatactatgtcgatgcactcgcttccggtgaatttaccaaactaggttctactctatgcttctttctcacttccttatttccacattaatttcattcaccatctttattcttcctagttgttacatatttctttctccttgcttaacgagctactctactgggtttatgcttaccttgtcagggttttgctggggagtcaaatcacttggaatccatttgaaataaataaataaataaaacaatgaacgaactaatttttgttccaatactagttacttatttgcctccaaaaagcttcccatgattggggaatgatcacatggacaaaaagttggctgccaaaaaatatatttgatagatatttccttttatttgatgatgaagcagaagcatatatgtctatatcttggcctctgtattcccttaaggttttcttaagcttactgtacttcagttcctgcacaggttgcctttagcagtttagcttccttcacatattaaagctcaagattctaattccactgtaggatattaggtcttataatccattattaatatattatttttatctgaagatgttttgaatttgggtgttgcaattagtcattgcttacattactaatctttggacaaatgatttttttcaatcttacaaaataatatatctattggctacaaactaatccacgcattcactccagtcattcatagcaaaaccttttaaactttggttcattctttttttttttatttgtttaattcaagttgcacttggtttatttttttaattgatccgaatttcttgttcaattcagaattcttatttcctaccttttgcaatattcttcatgcattttgttttatcaaacataccctttgataaaacaaaatgcatataaaggatatgaaagcctttctaactttttggattcaaacatacccactccctttccttaacaatggggaaataaaactcctttgcagagttttgacaaacatgtgaacatatagcatagttctattggtttttctttttggtagatgtactcagtgttgttgttgagggtgagccatgacacaactgtaaagtcgtgccttagtgaccagttgatcatgggaaacaacctctttgcatatgtaaggataaggttgcatacaatgaccctcccccatactttcgcgttgcgaggagcctttggcaccagggtacattagttttttttttatactctgttgtcaaaattgcgagtaagatcaaaggatcgccttctgattcccttgcatgctctcactctataaagcctaatcacattctctaatctatctctggtctctctgctttctgtgttctgcctcccattaacaataatctgcattctacttccagcaccaacatctctgtttatgcctttgaagattttgccttcaaggggttcaagctttgtgcctcactgccttcaagcttctatttttctgcccgtgctttatgtttaagattgctattgagtattacttatgttatgtgactttttatgatttgtacgtaaccttatgattgtgaattttcaattttagtttatctaaatattgtgatttaggtgttatttttgctatctatgttattttttgtgtacgcatgtgtaagtataattttgcatttttagtaggatcttatgattcatgttacaatcctgggttatataatcttctactcccttcccggtcttagctaagatcttgattttgacaacattggatatgctgatggtttggagagctcatgaagtgatttccccccttctttttctgctttatttaaggagaatatgcactccctgtttgattttgataaatttatccatgcctagaaaaatgtacagagttatctttattggaatacaacacaagatgtcttcaatacttaatcatgtgcttttgaaagcatttggacttagagttagcatgcaagcatataatatttctttagtcgaaccagcttgtttgatatctctgtgctttcagtttgcttgatatatggatgatacagaaagaagggatgggtagacaaggagcctatagaatgtgtctaacaccattgagtactttgcctttgtctttcagcttactatagtgatatttgtgttggagcaattgcatgccggctagagaagaaggaaggtggggggcaagttcgggtttacatcatgacgttaggtgttttagcaccttaccgtggacttggtattggtaagaaagaaactgaatatctttccctggtgattgaaagtttaattgatcatttttttaatgaccttggtgtggatacctgtctcagtaccacaaatacatattaatggtttgtcataaggtgcatgcttcatattgggaacatgttaatttacatctggcaacaatcactgtttcaaaatttatcacttccttttaagctcgttatttttataaactatgcaagtgttgtgatgtgaatcttttggttcatgcaggaacaaagctattgaatcatgttcttgatctttgctccaagcaaaacatttctgaggtttacttgcatgtgcagacaaacaatgaagatgccataaacttctataagaaatttgggtttgaaattacagaaacaatccagaactattatacaaacattacaccgccagactgctatgttctcacgaggtatacggcaagcacaacgaagaaataacatttcagccagttattttgaggggaagtgatcagagattgttgcattgttttatgggttttgccatggatgtattacactaaagtttttttatgttcaatgctagattttaccataaagttagctaaaaaaaaagcagcacttggagatctcttgctaaggtactattatgctattttacccgcttgctctcatctccccccagtcttatcatttccatcaaaatactattaaactacgaattcggtacaagaatctctataaacgattatttaaaatggaggcgcacagagtaaattaaaaaaatcacataaacatattgtaaacccaatttactttaagctgcatcctgtattttaaaactacatctagcttgtgcgtcctgaataacacttgcatgatttgggcccagcaaatggctcgttatcaaaaataataattataattataatataagatatgagagggtctcatggccacgcgagccttcaattgggccccatggtcgtcactggccatcgcacgtcgactgtcgtgtctccgtgtctcttcgcatggttattggattttgtaattattttattttttatcatttgttttaaaattatattattatgtatttgttgtgttattgttttggactgtgttatgtttttgttgatctgtttttcttctttttctagatgtgtttcttcgtagaatcagttaatgagagaaacaataaaaaatgttttttttttttaaatatgcagattttcaggatttttttacaatcaacaaatctttaatatgaaaatcttgagggtatttctattggatcttagaagaatagatcttcaacttaaaatttctctccaagatctggatatggcttgagagggtcctttctacgctttgcaactgcaatcatcattaatcatcattgtatcttctgctgaggcatttgctctctttgctcaggattatcacctttcaccgtgggtttttggttgtgggaaaaggtattttttttttaagtgtatggttaaaaattataatggatgacccaatttgggttggataaaagacaaaggctacacaacataagctaaacttcttacacatagtggaaaaggatttcttagccgttagatatagtgggattaaaatcaatggttaaattttcttctttctttttttgtttgtctttccttctttacccccgattccatccctcttcttctgctatcgcttttcgctggtaacgagaggttgttctctacgccacacctcatggcgttgccactacgagcaataacgcacttcgcccccatgatctcctacttcctttcctgttcgctttgaacatcagttgtgcgaaggatcagatctaatatgaagaatcagtaccaagcattggcatcatcatatttgaagaatcacatcctaggagacctgtgaaggactttgtggtcgccgccgcactctaatcgcgaagggaaccttgccgccggcctgcagcgtttactcgttgatagcagaagccgagaagacgccattgataacctcaccattcattctccgatgaggcaccaccgcctctgtggtccttgacggtagaagagcgaagggaagagaagacgaggaaagagaaaaagaaaaggataaactaggaagcaatcaagggaaatagaagaaaaagaaatctttgtttaaccatccattaaaaataaaagaatctaacgatcaaaaagaatttgcgaacggtatgcaagtattttaactaacgcagcgtaaccttcgtctaaatatgaaactttgtgagcaacttatcttcgaagttagaaatactagcaaaccaaacacgacataatgtttagctttctacttaactgaaccttttgtcttctttttgtaaaccaagcatacttatctcatttttttagtatttattggtttacttctatttgtttcgtgtccctctatttgacgttaaaataataaaattattaagaaattatatttatcaggggtgtctgcgatacatctatgtttgatttttaaatgaaaaattatccaaactaaacataaaattcttgggattcaatctgatttcatgtgaatgtaactaataacaaatttgaatcaaatcaatccaatattttttttatttttaaaatttattttcacaagacttccaaaattattttaatttgataattgacaaaataaattattccaatgtagagtgtaataattgagtcatgatcaacccttaaaaatgacatttacataattatagtaaatgaagcaaaaaaaaaatcacaggttattataattacattacaaacctattcttcaaaaaaatgcattaaaaaccattcatagttaattattcatggagtgtctcttttttttaccattgtttttagtcacaaaaatacataactaaaaaaatactcaacacatgaagttacatattttatcatcaaaattgggccatgacttaggttagaataatgaaaatttatttggaggcataaaaaaataattaaagtataatgcgtgatttacaataggtataaaaaataaaacctaattgcaacaaaaatgtggtttctttgtttgattatttttagtttttttagatcgatttactagtttaaagtgattagattgaattttaaacatctctaacacaacaaacataggcaccaattcataatttcatataaataagagtgaagataatagaaatgtaagataaaatgaatgatgagatgcaaagagaaagaaaaagaaaaaaaagtgtcgtataacttattatataatttattattattatatgaacacaatatcttaaaataattttcaatggcagagaagaaacattaataattattttgacatttgaacgttacacacggatcctaggtgttttatttattttctaaattgtgggctatggtgaaatgatttgatggaagaaagatttatgttaaaaaaagaacacgtggtatagagttgagagtaaagaaaagtagagaagggaagatattatccacaggaggcggggtgagattagatgatgattcatgatattacgtgtataaagctggttggagaagtagatcataatctcatcctcaccattcaatatccaccaggagttggatactggtcgtactattagtgggagcaatacatatcattcattcctagctaatcctctgcttgtaaattaagagcatggctgcacaagctcttgtatcatcatcatctcttaccttctctgcggaggctgcaagacaaactcttggaccaagatcactccaatctccatttgccttctccagaaaagcctcctttcttgttaaggctgctgctactccccctgtcaaggtctgtaattcctctctcactccatttgtttttatgttttcatctatctacacttgtacttaatatataaaaaaactctctttcttttggtgttcagcaaggatcagaccgacctttgtggtttgcatcaaagcaaagtctttcttacttggatggcaggtaaatttcatcctagttcatcactaacataatataacgatatcatcatgtctggatatataaacttctcataagcacttaaagaataaaaaggtgaagtgaagtttatttcatgagttaaaacataattaagttaatttatagtagctctttcgcttaatttctccaaaaaacttatgaaagaaacttaattcattttattccgttcctggaaagcttattcgaataacacttgtgtgtatctattgcaatttagaagagtagtaaataatgaattactatgttggtgctgaaattgactttatctggcatcatgtgcattgcagccttccaggtgactatggatttgaccctctgggactttcggaccctgaaggaacaggagggttcattgagccaaaatggctagcatatggtgagatcatcaatggtcgttttgcaatgttgggtgcagttggttccatagcacctgaaattctaggcaaggctggtctgatccctcaggagacagcactcccatggttcagaaccggtgtggtcccacctgcaggaacctacaactactgggcagactcctacacactgttcgtgtttgagatggcactgatgggatttgcagagcacagaagattccaagactgggccaaaccaggctctatgggcaaacaatacttcctaggactagagaagggtcttggaggttctggtgagccagcttacccaggaggacctttcttcaaccctcttggctttggtaaggatgaaaagtccttgaaggatttgaagctcaaggaagtgaagaatggaaggttggctatgttggcaatcttgggttactttgttcaagctcttgtcacaggtgttggcccataccaaaacctcctagatcatttggctgatcccgtgcacaacaacgtcttgaccagtctcaagttccactaaatctattatatcttgttcgcttcgcagttaccaaaactcaaccatcatgtggacattttttgttccttggtgtgccgctgtaagaattgacatgtaaaacaactagaaacattccacatctttcttttatccttttgctcgttagattaaccgtacccaagcttttatttatttcagccttctgcattccaaattgcactagtctgaataatgttacaattttataaactgtatatgttgtgagagaatttttaaaaaaatcatctttaaataattaatctagttaagattggatctcgccagaatgtagttaaactggaatgaatcctatactcaaatgtgcagcttttaaggcaatagcttaactcccaacatttgtttgacggcaacctgaaatttaaacagcaatcaagtcacaagatttttttaattttgctccacaattatgcatttgaaaatcgttttaattctttactattttgagtctgaataaaaagaattttttttagtagacaaaactcatttaccacgactccgcgagggagaaaaaaagactaaacgctcttgtagagttttattttattttattccatgcataaaatttaaacatgtaactttaagagaaattaagttttcttgtcactcgaaccaaatcacgatataaaaatgtattattttcttctataacttcgaaaaaattcttaatctcattgtgatgtgtattttgcgtggtcagaatttttcgggcgagattatatgcataaaaagacaaaaactgctggaagaacaaggaccaaccaattggtgtgatttcaaaaagaattaaatgaaagttgatatttggtataattttattaaggtttaatgtaatttttttttactatatcaatcagttaaaaattatcttaagggggcatttattttacgtcatgttattcctctattctcagggataccaatgtttgttagaaggttatgagaatttataaccatgtatattgtattcccaggggaatgttatatcttcgtgtttcaagcaaattctattcccaagagaggagggaagggtatatgatattctcatgggaatataactatctattctcattacatcctgatattctctttttacttttacttttttacatttttaattgttctacaattactaaatgccaactaaatatgtatatggaaataacattcttaggcataatattccccggaatgtgattgccgggaaacaaaattatggtggaatatgattatgtgaggtgtaggaagcaaaagcccagagtttcctaagaacaaaaaaatgtaaagcaggccgggcgattcactagagggtccaacagataactaaaaacagagtattgaggcgaaggtgggcttgagtgggccataccgtacagcaaacaagtatcattttcattttggcgaacgagtgcgaatctttttctcttgcgttgttattttatttccttactatctccatctgcatctacatctgcatctgctacgttgtgttgagctttgagatctgtctcgccaaaattcatggttcctttcctctctaaccagttctcttccttttccctttgcaatatgttgctcatgatgcctgcttttgcttcttgttgctgctttttctcctgcatcgattaattttacattcctcgtgtttttgcttctcgttttgttacttgttagctttatcaatggacttgtttgctgctatactttactcttgtgatctgattctcggttttaaagcggacctgcatcgccttttttttttttttctgcttcaaaactattggatctgatttcaatatgttgatatgattgttattgtttattattttgtgcttgcatttggctgttttttttttttctttgaaaatatctggcctctcatgttgaaatgtttattccattgtagatttcgtgttgaatgcatcgtcagagttaggttaattttttgacatttggtgtaaaatggaggtgccaagtaggagaaaaccagtgatctactgggtttgccttttcgtcattgtcaatgcgtttgtacaaattagcaatgcattttatcttccgggaagctacatgcatacttactcaaatggagatcagatatatgccaaggttaattcattgacttctattgagaccgagcttccctacagctactacagtctcccttactgcaagccccttggtaaagtaaagaaaagtgctgagaatcttggagagctcctcaggggagatcagattgataactctccctaccttttccgcatgaatgttaatcagtcaatctacctctgtactacgaccgccttgaatgagaatgaggtaaagctactgaaacaaagaactcgtgatctgtatcaagtaaatatgatccttgacaatttgcctgttatgaggtttgccaatcaaaatgggattaagatccagtggacggggttccctgttggatacacaccacctgatggtagtgcagattacatcattaaccatctcaaattcacagtcttggttcatgaatatgaaggaaatggtgttgaaatcattgggactggggaggaaggtatgggtgttatctctgaagctgacaagaagaaggtatctggatatgaaattgttggctttcaggttaccccttgcagtgttaagcgcgatcctgaagtcatgacaaaactccacatgtatgacaatatctcttcgacaaactgcccatctgagctagacaagtaccaaccgattaaagagcaagagaggatatcatttacatatgaagttgagttcgtgaaaagtgatataagatggccatcgcgttgggatgcttacttaaagatggagggctcccgggtgcattggttctccatcctaaattcattgatggtgatctttttcctagccggtattgtctttgttattttcttgagaactgtgagaagggacttgacaaggtatgaggagttggacaaagaggcacaagcgcagatgaatgaggagctttctggatggaagcttgttgtgggtgatgtatttagagagcctgatggttcgaagcttctctgtgtgatggttggggatggggttcagattcttggaatggctgctgtgactattgtttttgcagccctgggtttcatgtcaccagcttccaggggtatgctgcttactgggatgataattttatatcttttcctgggaattgctgctggatatgtcagtgtacgtctatggaggaccattaagggaacctcggaagggtggagatccatttcctggttatctgcatgcttttttcctggaattgcttttattattctaacaggactgaattttcttctctggggcagcaaaagtactggtgctattcccatttccctgtattttgagttgctcttcctctggttctgcatatcagttccacttaccctcattggaggatttatggggacaaaagctcagcaaattgaatatcctgtgcgaactaaccagattccaagggagattcctgcacgtaaatatccatcatggcttcttattcttggtgcaggaactcttccatttggaacccttttcattgagcttttctttatcctttccagtatctggcttgggaggttctattatgtatttggtttcctgttggttgttcttctattgctggttattgtttgtgctgaagtgtcagtggtcctcacatatatgcatctttgtgtggaagattggcggtggtggtggaagtcattctttgcttcaggctctgttgctctttatgtcttcttgtactccattaactacttggtgttcgacctgcagagtttgagtggacctgtctcagctatactttatctcggctattccctgctcatggcaattgcaatcatgttgtcaactggcaccattggcttcctgatgtcattttactttgtgcactacttgttctcatcagtaaagatagattgaagtttgctttgctatctctcaccaactaagcaaaaggcatgctggaagaggaaattttcttaaatagtataacttttgcttaattctttttgtagcttgattgctttgcagcatgttgagtggggaaatagatgccttgctgattgcagtaattagttgccactcaattttatgttgctatgcgaactacagtttgttccactctctatctgtctctcccgtaagttgtttactcattcaactagtgtttggtatcattctgtttcatgtgatttagttttgtcaagttgtttgaggaagttgtaatttgcacagactgtctcattccttattcaaatatcaagaaaaattaaatggatacttctaggtttcttcaaggtatccatccactgtgcttttgggtgttcgaatgttttgtgttcaaggataggaaagtgacttattcgttaacatgatttttcttagttatccacatacggcttggtaatatattattattattattagcaaaaatacaggcgtgtgtctatatttctattatgttatcatatttttttatttaaatttatttggtcatacaatataataaaatataacttagattatttctatagaggcaactctattatgagaaggtgtaaaaaaagatacaattattattgttctggtatatcaacaaaagctatttgataatacacaattaagagttgaaaggaaaactagaatgcattatttcttctccgattgattaaccttgaaaaggaggagaaagaaaaaggtgaattgtcatccttatacttttgtgtctgtatttttattttattattacattttttgctaataaagaaaatgataaacttttaaatttaatttaaaaaatctcagttgtattaaaaaagtccttgtcatcatttgaaaattattttaaacataaatcaattgagtcaataaattaatcagtgaagcctcctccgaaatagcatccaaaataaaactaaaatgagcacggcaatagaaagtaaaaacatgaaaaagcacacaaaaaaaaagacaaatgcaaataaaccaaagtgatttatgcgtacatgacctatttttaaaagcactgtttattttagtgaatggaaatgaaaaatgaaaggtttgattcctgaaaaagagatgcagaggaggaaagggataattgtaaatgggagagagataattgtgaatgtgaaagagtcaatttgaagttatgttatgcacgttcatgaagtagaaattatttttgaataaataaatcggcgataactgccgtgagtgagtgtcaatagaaatgaggagaaaaaaatttctaaaacaagaggataagaaaggtaaggaaagtttgaaggggagatttacgggaatgagaaaaaggataaaataatgcagtggacgtgtgaacatagtagttgaagggagaattagagtttgcaattatattttgaaaaatgtaaaatatcaaattgtgtgggagaagttgcagtaagccagtaaccaacaccttttctgtgagacgcaacaattatttttgaagggtaaatttggaaacgaaatgtgtacaaaaaggggtaaaaggtcctgggagtgttgttatgaagtacgaaaaatgtagttatatattgaaagataaattagaaattaaaaatatgtataccaaatggaattattttcaatatacagattattattatttcatactacttcatactgagaacatacatatttgtcgtggatgtggaaaaaattaaataaatgtactgaaaacgacctgcaaaaatagaccagtctattagtcgctggttcatggaattggatcctgtgatgttccttttcgtattctggtaaagccaaaacaagtttaagggatcgtgtacaaataaggtgagtcttgttgtgatgtttgtgtctttatcttaagtctgagagagatatgcgcatgtttcttttcacgtctgattaacaatggacgtggaagctacaagttgtggcatcaagatgaacccgcatgatgtccctacgatgtgaaaccaaacacatgctaaatttgttttcagtaaatagttagtgtggagaggacaactggttcatttgtctgtctatctaactctcttgatactgtcaatctcatcacaaaaggaagctatcctctcctgctgctgatactagctagtatcacctttgttaggagttgagtttgttggttggttttcatgtatcctaaaaaaaagaaaaacgaagaaaaaaacatttataaattacaggtgttttgtataccttcctcgtaggttttgtatggttctgataacaaactcccggccacgctagaagtgaaagaattataacaaacctttgttataaggattgcttcttctggctagtattcccttagccatgctcttcagtttattgtttatccagtttggcaagttacaagagaaacttttgcgtggatcttgtctgcacaagctatttagactaaattgattggtactatatgcaaaattattttatatttgacacattacagaaatttgttttttgacaagataaggcatacacaataaattcactctagtttttctcaactagttattcaaataaaatcctaaaacaaacatcacgagaaaaaaaaaaaaaaaaaaaaaagttgccagcaagttattgtctaacagtagaacattacaacattatattgggatgggaaccccgttccaatctccaagacattccagaatgggatcaataatctttgcttgacacatggctgtatatactttttcaaattcctcatctggtgagagagtcttttctccggtgagcaaccctatctctaactcttccctcacaaacttgtacagtggatatgacctacactcctttattctgtttggaattgctggattgccattctcataagccacccttgcactttcaacttcctttggcaagagagacttcaattcatcctcaaaagctccaatcttctcaaaaatcaacaagctcacattcttgtcattaatggcactaatgtgtgcttgctcataaagtacttgctttagttttggcatcaatgggtacgtaacattggagggatcatcaatgtaggaaaatacatattctctatcgaccactttaagcaaatctttctcacaaagtcgaaatgggttaatttcttctgtgtcttctgtaactaatgttttctgtgcaactatgcttacagtattcttgaccgtgttcttgaaaatttcctctaaatgcctcaagtcaatagcttggcagagtgcaaccagataagtggaagacatgagctttaatatctcaacggcttcgacagttttcaaagcagaaattaagcccaaagagttcacatcttggtcgtgctgctcagcactttgcccatggctcgttactggatttgctagatattgaagctcagaacaataagcagccatggcaacttcagatgccttgaaaccgtaatcaagacttgggtttctaccagcagaaagacttgatggcaacccattgttatacaaatcattgacaagctcagtaaattgggcgaagatgagtttgccgattgaagcaacggctaaacgtgtattatccattgaaactccaattggggttccttggaaattaccaccattcagagccttattccttgtgacatcaatcaagggattgtcatttactgagtttatttccctttcaattgatttggtcgaataccggatgatttcaatctgtggaccaagccactgaggagaagttacaagagcataacgatcttttctaggcttctgcaacggatctggttgttgcagtgtaacatttttgacataagagcttccatctagaatgtgttccataatagctgcagcttcaatttggccgggatggtacttcagcttatgtataagatgatgtgtaaattctggcttcccctatgcatgacttcagcaaaaactgctgacagaacttccgacagtaaagctaatatgtttgcctcaaaaagcacggtagaagccacgccagacccaacggccgtgccatttacgagggcaagaccttccttgggcttcaactcaaagaacccagaatctagacctgctaaatggaaagcttccttagcattaagggactctccagagggtccaacagctttactgtttcgcctaccagttagcaatgcaacaatgtaggacagaggaattagatcaccagacgcagtaattgtaccacgtaatggcaagataggggtgacattgtggttgagtagtttggtgatagcttctaagatttcaaatctaattcctgagtagccttgaagaagggtattaaccctcacaagcattgctgctctggttgctgatttaggcagtgtgtgagataactctgtttggtagccaaatattgcgcagtttaaaaaccttgggaaggaaaaatggaaaatccgtaaatacataaaccaaaagaagaattaaattggaatggaatggtctatatactgtcatataatatataggttgttgtcacatatataaaagtaagttgacttttataattgatactttgaaagatatatttgaaatgaattttgattagtattgacaatgaagttgcatgataattccaagatattgagaaggaagcagagaagaagcagacctaaccatttccttctgaagggcaaggccttggtcagttcttctgtgggaggcagcaccaaagccggtggtaacaccataaatgggagtgcctttgttaatgttttggatgatccagtggcagctggcgtcaacgcctggccttgaagactctgagagggaaaccttagcctgcaagtaatggttgggatcggcaacagcaacagaagccacctgtgatatagttagtgtctctcccccacccagacagacaagtgggttccggtactctgccaccatgcgtttcacttcatcaaagtggctacacttgagtgaatctgctgcctgactccagttaagggggtcactttctggaataatgctcgccataccactacgagaggagagttcaaaagttgtagagttttcagaggccttgaagctttaagtagagctagagggttgctgacatgtgtcggggtaggtgattaggtgcttctatctaccattcacccactcattttttgcatcttacaattgtagcttctcaaatactgtctaagtacaaacaaccagattaaattataaatttggtcactgtctgatattaattttagtttcaatcataactggcaaataaatttatattttactactctctgcataaaaacatatttcaatttttttcatacacggcatctaatatatataaaaggttttttcttttttttttaggaatgaagtagtaaatttacctggtgcatgggttgcactggtatttatgtatgtaccaaaatagtttgttggtttgtaaatataatgttttaattacaatttgatttgataaattatttaaattggttgttaataaaattttataaacataaaaatatatatttaaacgttttagctagaactcatatttttgaatgatttaagacacattattcttaaatcatttaaagataagaataacttcttcttttattttatcaatatgatgtgttgaatataaccgtataaattaagagatatatagagcgcaagttatcgtctcttagtagtattgtagtaatactactatataaaaaaaactttaatatttttataatctttgaccgacttaattatttgtataacacgcatatttcattattttaataagaagacataaaccttttccccccacgtgttgtgataaattcctgaaagtatacattttttatttgtgtagctaaaacaatgtattattgatagaaaataaaaagaaaagaaaagaaaaagacatggaatagtattagtaatgacaggtttcatgttcccgtaaaaaaaaaaaaatgatgtttactttgttattacattacacgcagttaacagtaatgaaaacttaaaattagtaaacataaatgtatagaaatccgtgaaaggtaaggaattataaatgggatgtggaaattataattactctgaaaatcacatcccagatgtatatggtattatatttgtgtgtgatataataaaaagaggaagaaagaattatttgtgacgcatgcaagaaggtttgaaaaaagaaaactagccgttggcaagggtacttcatcatgtattagttgtacattgtgattcagtgctttaggctcctctctttcctttgcttttgcttttgcttaattcattgatctaaattctccttcctctctctgactctggcgaagatgttcaccgaaggactcgacgagagcgcaatccaatggatcaagcaggtctcctttcttctttcttctttcttctttttgtctaatctaatgctacctctttgtttctttttccatctttctttcttttgtttgattctttattagggattccattccttcactgaccaatttatacatacaatacaatacaatacaatacagggatcaaaagtaccacttgatgttgatgtcgaagagcctcctcttcctcagccacgctctcctctggccgagaaaatcagctgcagcagcgatcgattcccacgatctcctctcttgagcagtgccaactctcttaattctcccgttctccctcccttgaagttccactcggctttattacaaccgcgcaacctcgcctttgccgatcacgatgacagttacgaaagcacggaggatgccaatttctccgatgacgaagtctctgctcccaacaaccttgatttctcggactctccaataccacactactatgacgaggaacaattgtttggatgcaaaggccgcagaggaattctcaagacaggtttggccaatcaaaacctaaccattcaggttcccaacacagttagaaggttcacagatggagaaatgggtttcaatataagtcttcaaaggaacctcactccagctggcgctgccactgttcagcttcaaaagcaagttcaccttcgcaatgtgaattgccctgatgatgacaccgttggtttgggtactccaagtgcccctcccatcattgattctgattctccactggagagggattcagaatgctccctaaggaacgaaccaacttaccctcctggatcatggccttcaagagaatctctggattatgatggcacaaaaagtgagacttccattgaacaaaaacccaagcccaacactgttgctaaacccactgtcgctgagctcgctcaaaggtgctgtatttgctcttttttagtttgtctgtttgcagttctccttccaattcctaaccagctctagtgtccttccttataatattaaattcaactctgcagactggacaagacttttacagatgacagagaaagacagacccctcatttacaatattacaacaccaggtgctgtctatcttcaacttttactttctatttaacaattatcaaattagctgtcaaccttaacgaaatatttagtttagtttgaatccattaatactttgctaaaaaactaagtaccctgttacctggaggctccacgctatgcgcaggtaagggggatggatattgtacacaactttactcttgcatatgcaaagaagttgtttccggattcgaacccatgaccaacattaatactttgctaattatagcaaaatttaattaatatagttatcttgaaattcacatttatatgctcacttccttttatggcatgttatgttatttcagcagttgcaatagtcaatatgcctggcaaacccttatcacttatgatgcctgcatacgtttatgcctacaagcatgggcaaaaggctgcactgaggccccagagtttttaaaagatgagtgcctagctctccgaagtgctttagggtgggttccattttgttttaccaacacatttcttttggcttcatttattgttctcctcatttctgttatttctctatttccatagattgcatgagttcttgttgcaacctcgaggtgtcaagccaactgaaggcagaaataccaggaattcggaacaaacagttcccctgaagattaagaaagttgtagggaaaataagagtggaaggtaatcttacaatctcaacacatttttatcatttaaatgtaatatgattataattgtacatggatgtatggaatgacattttcttatggacatattttagaacttcctaatgtaactatgttcataacgttggatctccttcaaacaacttgagagctgtataatctgacatcctatatgaaaattgcagtgaagaaacttcgcattataccaagacaaaaacttaagatcacaaagtcacagcgaggatcaatctacatgcaaactggggtggagtacgtccggcatgtttcatcacttgtgaaaaatggcataaattctatgaagacggcctccttctccttggcatctgaaggtttcagcaactctttcgttttatagtttagaaatctttttgatcttgataatgagacttgtattagactgtaagagttacatattatcaggatttaggagtcatactttatcctccaccaaatgaaatgggcttttttaatatagatttttttcctttcataaacaccaatccttttaatgaatgaattaaaggtatctgttttattcttgtagagccactacattgttcgatccaacttaagagtacaacggaagaaaatgaatcagagccatgttctgcaattcttttgcgccctggaagtggagattaccatgatttgtaagtttcattttttttttacttttatattttaattgggaaaagtgtttttaattgacctgctgtttggctcttcttagaaaatagctaaacatgatagtcggtgaaggttttccaaatgcattttagcaggatatttatagtagtagacaattgatgaaaaaccaatcttaacagttgatatcatacactgctttatgttctaagtttcttccagtacacagcctagtgcataagatggcgatttacattgtacattctttaagacaactacaatcacatgttgtcttgatttcttcaattgttgaaattcgcataataatcataaagattctgaactctcacctactttcagtttcccattgagccaaggggacgctttaattgtagaagtccaagattcaaaaaaggtagtccatggtgaagccaggattccaatttcatccctcagtgataatcctgtatgagctctaccctttcatcgtccatggatattattctctctcttgcaccttccacattcacataatgaattatcttgaatgtgcagagtgacagaattcggtggtggccagtatatcatgatgaacgtgaatgtgttggcaagatccagctctctattggcagtacaatgacaagcgatgagaacaatcacataaaggttctgtctctagcaaaatttagttcaataaatcttgttttatctaatagaaatattcaagttagttgatgtaagatcatcttccaagttgacatctcaggactaaggcaaagaagtaactgtttaggatacatcttagatgtaatatatcgaaaaattgttctcaagaactagattctttctgagattaaccatggagaggatcatacttatcaccttgtttaatcatttgttggtattaaaaagaaaactattctaatttgatcggacaaaggatcttttatttatttattgaaaaggctcatcatgatttaatattgtttttatcttagtttaaacttttggccattaaacaccaatatcaacatttctggctatgctgttctgagcatagattcaggttttcatttgctcggtttgtacatttctgcagagtgcggctgttgtggaaactcaagcttatgatttattattggagggtgccatgcgtgcacaacatttccactcccgaaacttgcggttaaatgggccttggaaatggttgttagatgcatttgcggactactatggagtttctaattcatatgccaagctgaggtatttgaatgtgtgcccccaaaaatatgaaaataagaaacagttttctgatattctttatgctacatgattttcttttaatttcttcatttttcttcacttacctgtggtggttttcttgtagatatctattacatgtgatgaatgtggcaactccaaccaaggactgcctagagcttgtgagagagttgctagaacccctcataaaggccagaagtgagaggagtctgaccaggcaggaggtaagtcatatattgctctctttcccgttgcagtaatttaccatatcttgtaatttggtttgcttaatcttatgttgtttcagcttctcataattttaatatgctatgtcaatggcattagtttagagttcagaccaccttaatacttgtcatacatatctagaaatggatggtggtgtaacagttttctctgtttgcttgttctcacagagaagtatactttcagactgtgaaactcaaattgaaagtcttctagcgacagtttttgagaattacaaatcgctagatgaaaactcgccaacaggtttaacagatcattttggtccagcatttgatgctgctgcaccagctttagatcctgctgttcaagtctacacaagtgttcatgatattctatctctagatgctcaaactattctaagaaactatcttcaggtaattccaaatttgcagagttactgataactaatgctcttgttcaacatagtttcaaccatggatgtttgaagtatatttatggctgcatgtaaagcttggttttccttttttggagtctaaatgataaggctactgtcaacagactgcagcaagaaaaaggtgtagaaaacacatgatggagactgatgaatttgtgtcgagcacctctgaatgttacctaatggataccattaccatctcaacggcatacctgaagatgaagaatctttgtgtttcaataagaaatgaaattcaagcagacataaagatccataaccagcatacgatccatggtcagcatatatttccaaggtagttggctataacagctctctttagcaagttgacaatacagttaacagtgcatacaatttgcaattcaattctcacacataattataatgaggggttgatatttatcttttttacatcccctacatgggagatgcaattggtctttattaaatttaaacattctgcaactttcaattggcataacagaatgttattttctcctgtttcagtcagagtttctcattatcaacgtcggtacccattcatccaatgatagcattactcaaattctcgttatttttctctgtaaattttaattttggttcatcatagattttctgagttctattttccaattttcagttcaattgacctgacaaacatcacagcagcagtttacagcacagagctgtgcaagagactgagagctttcctttctgcattgccaccatcgagtccacaggcacatgtaaatgagcttctagttgcagctgcagattttgaacgggatttggaatcatggaatataaggtttgtgaaagaaacttctcccatgctaatgcaaaatgcagtataaaaaagacatgagattccccaacagtaaaatatcatttcttactcgcaatactcttcatgttccagtcttgtgcagggaggcgtagactccagaaatttgttccacaattatatcatggtgtggatacaggatatgcaacttagtttgcttgatttatgtaaagcagaaaaggtagtagttattttttttttttatatatacaacaaagcacttcagtctataaatgacttgacctccccaataatgacacaggtgccatgggctggagtaatcacaaaccactccacctccccatttgctgaggaaatgtacgagaaaatcaaagacaaccttacccagtatgaagttgtaatcaacagatggcctcaatactcactttatttggaaaatgtaagttctaaattagagatatttctgttaaaccatcagcattccagatatctttttctatagtgtctccctcctctcatatatataaacaattctatctccactgtataaaacatgtggtaaataccttgactttgcatttttcttaccctttctttctgtaaggctgttgcaaacattgaaagggcaattgtgaaatccctcgaaaaacaatacagcgatatattaactcctttgaaagatagcatacaaaagagacttcacttgcaagttcaaaagatagcaagaagacaatcagctactgttcatttggttcctaatcaagtaagttctctgtatgcttttgcattaggtccatattctaaaatccagcttaatttaagtactcaaattttaagctcactcaaacttttgtggcataatagaaaacatgcaggattttggtttcttataacattttgttttatccacagttgggaatattcttgaacaccctcaagaggattcttgatgtccttcattgtagagtggaagacatcctaaattcatgggcatcctgtctacctgtcatgggagataagaagacactgtttggggagcaaatgaatggaatcactgttctcttgagaaccaaatacaaaacttatttgcaagcaataatagggaatcttgtcaacaatgtaagatcattcaaactccagttttctacgtttgttctatgttatcgtaaaatggataacaatagtgagcataaagtttttgtttagaagcctcaaatatttatttacatttgatacaattgaattgttcagacaaaagctaatcggaacacaaggctgaaaaagatccttgaggaaacaacagaaacagatggagaagcagaagtgcgtgaaagaatgcagttgctgaattcacaactcactgacttcatctccaatctgcatgaggtctttaccagccagatttttatagcaatatgtcgtggattatgggataggatgggacaggtaaccaactattttaaaaactcctatattattggttcatatttttttctttctcggatctcatttattttcattggttttgtgatagattattttgaaatttctcgaagggagaaaagaaaacaggatatggtacaacggctcttcatatgctctgggggtaagtcaatattattagattattttctgatgatgttattgttgattgcaatattgcaccgttgacgttgattgtttcactttgcagatattggatgatacatttgcttcccaaatgcaacgattacgaggaaatgcgttgcaagaaaaggatattgagcctcctcgctcagtgattgaagctcgatctattctttgtaaagacacggcaaatgcaaccgatacatctaattacttctatatataatttagctttatatatatatattgccaaatttccttgctattgttgaaatgtccatccactgtacatgatcgtcaagtcaaatataaacctggtaacgtttttctttttggggggagggggattcattttattcttttgcatctaaatgtaataatgtactattgttcagacttcagaggttgaataacgtgatagagggctattattcttcttgttaatttcctatcaatctaaacacatgatgagagtgtttgatctaaagaaagaatccagaagaaattgcatagataaagtaagaaaatattttatatttatagactttttatttgtcttatctgttaactttatttatatttttaattaattttgtcttttattaattttcttttgttttttattactatgattttatttttcacatttttgtgtgtagttaagggattttatatatatatatatatatatatatatatatatatatatatctttttgtttttgatcatgtcatatttacagtattagtcgtataaatttgtattaaaattgatttttggatttgtatttggatgtttttttctgctgaattttatatttggattatgaacatcaaattataaataaatgacttaatcggtggttgataatgttagaaaatagttttattaaatttttgtaaggtttaagatgatttttcctcttaagagaagtttataaaatgaattttttatgtaaaccttaaaacatgcgttaaaaaatgaatttaaatatcttttaagttaacatgttttataatgacttcaagataatgttatgcttagtttttttccttctaaacaagtaaataaataaataaaattcattgtcctaaattttatttatttattaaatgctagcataaaaacaaacatcattatatatttctataatttgttaattttgaatataaatgtttaaaaatgataacaaactaaaaagcaggaaacatgatttgaattttttttttgttttgtaatttcaattagaaaaatatttggataatctttactctctacacatttttttatatttactttatatatttattcatttttcttatttttctctacaccacatatctaactttgaaatatataaaaaatcttcataattaaaatatatacaccccttagaacacagataattaaagatcaaaataagaagaagaaaatcaacaagtgatataataatgttattatttcaatgtttcataaatacatataataaataaaatgatattcaaatatataccacaaataatttgatgaattatgtataaataaacatatatttaaaaatataatatattaatttatcatgttatcataacaaataaataaatttaagtaaaattatgtatacattacaaaacatattaaactaaaaataatatgacatcaatttatagataataaaagatatcatttcaatatataaattttagcataataaagtaggatagcttaatagaaatacgaacacatatacagtaattactataattattaatgagttaatgattaatttattataaaaaaaagtaatgatcacttttttaatagttcaaacgtatcttgttattttaatgaatcagtgattattatttttagaggtaacgtatatttattattatccatgggatacaaagttacaaagtatgggctggaactggatatagaaagaagagaagcgaaagggcgcgagggggaaatggcgaaatgaagggagggaaagaattagaaaatggaaaatattcaaaagggtgattccctcgctccggaaaatccgaaatttggatattccactttctcacttttccctataaaacaaaaaagcacccgaaattgttggcagtggaaaatggcgcagcttccgtgcgactccgatggcgtgtgcatgcgctgcaaacacaaacccactccctccgaaaccctctcctgtcgaacgtgtgccactccctggcacctttcgtgtctcccttcgccacctctctccctttctgattcccactgggactgccccgactgttctgacacctccaatcatcaccccgtcgctccctccggtgaccttgtctccgccattcacgccattcagtccgacccctctctcactgaccaacagaaagccaaaaaacgccaagaactcctcgctggctctgccgacccctcaaaggacaaaaccaaaaccaaagacatttttgatggaagcttaaattgctccatatgcatgcaactacccgacagacccgtcacggtttgtttcttttgtcttctctgttttttttttttttatcatctattaatttttgagtagtcagtgtgttagtttcctcaatttatctttcagacgccatgtgggcacaacttttgtttgagatgtttcgagaagtggatcggacagggaaagcgcacttgcgccaattgccgtgctcaaatcccgaccaagatggcgagccagccgagaataaactctcagttggccatggccatccgattggcgaaggcagccaagtcgggaggttcttcgggtccatccaaggtgtatcattttgtacgcaatcaggaccgccctgatactgcattcaccacagagcgagccaagaagactggaaaggcaaacgcttgcagtggtaagatttttgttactgttcctcccgaccattttgggcccatccctgctgaaaacgaccccaccaggaaccgtggtgttctggtcggggacacgtgggaggacaggatggagtgtcggcagtggggtgctcatttgcctcatgttgccggcattgctggacagagtggttatggttcccagtctgttgccctttctggtgggtacgaggatgacgaggaccatggtgagtggttcctttacactggcagtggtggcagagatctaagtggcaataaacgcaccaacaagctgcaatcctttgaccagaagtttgaaaacatgaacgaggccttgagagtaagctgcaggaagggttatcccgttcgggttgtaaggtcacctcttctctctcgatcctaatatttttcattcgattaccaactaaatgcatttttctgagtatcacaaatttattttgtgccgaaataacttttgttttgttcaggtcgcacaaggaaaaacgttcttcttatgcaccggaatctggagtgcgttatgatggagtttatagaatagagaaatgctggcgtaaaaatggaatacaagtaagctacttctaatgataggcattgtgtttattgattgaggcctgggaatgtatttttccttgatagttttctccaagttttttgattcatggagaagctttgttctgtgacagggttgcaaggtttgcaggtatttgtttgtgagatgtgacaatgagccagcaccgtggacaaggttggttggttctttctttgctgctgtttgtttgtgtgcttatgtgttattgactttattttgttgatgtgcagtgatgaaattggagatcgcccacgctcactgcctaaaattgatgagttgaagggggcagttgatgtaactgaaagaaagggtgatccatcatgggattatgatgtaagtgttgttctggtcctttagctgttgataggttgatttgtgtctggtaggattaaatagtgagacaatcataattattgtactaaagagttttggaaatcgttctagtggtacatgttccactattgatgttctataatctatactttgatgggtctcactcagtacttttggtgaaatataggaggaaaaggggtgctggttgtggaagaagcctccaccagaaagcaagaaatcagtggacattaaatctgaagatggaacaacaatcagagttaaacgaaaggcaaaagatgtgtctgtgaaagaaaggcttttgaaaggtatgctctgtgtacatgttcccataatttaccctgtatagactacttataaatcttgtttgccttattgttttttaaaatcccattgcagtcaattgaacttgtaaaatctattcaattttgccactgacttccaatttgttcagagtttggctgccaaatatgtctcaaggttatggcttctcctcttactacaccttgtgctcacaacttctgcaaagcctgtttggagggtaccttttctggccaaagtttcatcagaaatagggcatgtggaggtggacgcactttacgagcacagaagaatgttatgaaatgcccatcttgttcaaatgacattgccgactttctccagaatccacaggtactactgaatgccattattaggttttatatttgctccaagtatgcttgcaaaccatatttggatttcttttaattattcctagtttacaatgaaatgcttatgcctattttttgaaaatatggaattcaattagtaaaacggttcatcttgaataaaggagaatggtagaaatatattaaggctttattttgagctcgtgtatatgctttttataaggcttgaatatttgttgcaaatactactggcactaatgaaatacattctggaatttttcattcattgtattcaaattggcattttatttgtaagttttgttctacaattttctggccttttttgtacaggttaatagagaaatgctggccgttatagaatcattacaacgccaggctgaagaagaaaattctgaagagtcaagtgataaaaatgatgaaaatgtgcatgatccaacagaggtttcaaaaccttgtgattctagtgataaggtgttggaggaaattaaggacaatgagctgaatcagccacacaagcgaaggaaagagtgaaggatgactgcaagttattttggtcctttggattatggattttcattaaatagcaagggacggactgctgatgcaattgttttttagtgctagcatagattgatggattttgactaatatatggatttaaatatattttttgtgcgttatgatcggagtagaggttcatgtgatagaatattggtatctcctttattgtgggtttcatgtctctagaaggagagaatgaatgcagtttacactgtaatgcatatcttaatgcattctgtgtttttattaaagatgttatgtttactactacatttaaacaagtttaaatttaatattgacttctggtgtaaacttaaatgaagagccaagtgataaaaatgatgaaaatttgcattgcccaacagaggtttaaaaaatgatataatgataggattaaaaaacttcatactactacgcattgtaggtacacagaagtatacacgaggtaaattctgagaagtttccatcctttgtgggacatcaacttgtgaatgtagcttttgattcaacttaaatttgctataattggctcacaagtatgtttgtctaaatatcttgcatcaacttgtgaatgtagctcgaggaaattttgaagatttgagcaaggtgaggtttaaggaattaggtaactaaatctgaaggtaagctttgttatcctctaactcacctttttatccaatattataggattctttttttttttttttttttacaacgttttacccattaggttattagaatacataacctttttttttttttaccgatttagcatgtgtattgttatgatataatttaaattattgatggattgaaagagatagaaagttgcattgttaggaatattaagttgcatttatatatatatatatatatttttttttgaatttgatttatgataatcagttataaattgttaaaatttaaaagcttaagagcatattatgataagagaatattgaaatgaaatgaagtgaatgttagagaatgaaaatctaaagtagatgaacttatgcgttttgtaaactaaaagatcattatcttttcacttaaagagaatcaagaatctgaaccacgtaggtcaataagttacaaagagagtcgaaaaggtaaatctagaagactgaaaatgaaaattcgaggaaagtagacctttaagtttaattattattacattacattagtagttacaaagaattttctaaccaattttatatgctcatcagcgctgaaatttcaacttccaagtaaattaaaaaaatgaaataattacgtagatatgttatgggttaggatcatttgtcaaattttgcacaatgatatatttaattattcgctcgaattgccgcccttctcatgtggtctgatactcggacacgtttttgtattttatttaaagtattagttgactgacttccggtcgtctctcaaaagtcttcgttattaattataatgcaaaaatgattttttttaataaataagaaatcaagaatcagatcattttcttttcttttctttttaggatttttcttacggcacctattcagtaaccacagactaatttctctgtttgataggtaaaaattatttattaaacaaatttaagtcactttattaagtaatatgtacgagtattataaatatttttatattgtcttctgttcttataaataaaaaaattaagattatttttcgttgataatgtttaccatttttaataaataacacgtattgagaaaaatgataacttagtatttattattaatatacaagattgaactctttaagatcttttttgctctctaagttaatactgttccacttccatgtatcatttgaaaaaacaaaataacactcttgagatgtctataagtctattgaagaagacataaagaaaaagaaagaaagatgctaatagtaattgagtaataagatgtaaattgtaaagaagcttttgccataagctttttctgcgtaacttctaacacacgctgaggaggacatcccctatttatatctcatttcaccatactgtccatacgtaaatagagccccattcccctgcttacatagagagcacttttcataaaagttaaattccaagagaatgaagaagatacaagtatcaatcaagtttctgctttgtttatctctgctctgtcttttgttctcttcatttcttttactccttcaatccttgaagccatccctcatgcaattcttcagctacatggttgaaaaaagctacatgttccttctctgcaatggcctccttcttgttttaatagccatcaactctgctccaatcaatgcctcttcactaccaaccactgaacatgctgctgtagctgttcacatagaagagaaaagtagccagttagaatccaaggaaccagacatggcagttgcagcaccaattgctggtgaggaaactgaatccccacataaagaagaaaagattttggtgagagtagaacaagacaatgttctatcagatacccaagaagaagaagaagaagaagaagaagagggaaatgcccttgtgatcattgatgaagatgagcatgacactgaagagttaaataagaaatgtgaagattttattaaaaggatgaaagcaacgttctcttccaataacttggagctaagagctgtcaacagtttttattttgataatcagaaattgctggtggctgttaattaagtagttgtgaatcttagaacatcatgtatctccctttcttttgcattgattttaactaacagggtgtcttagtttccaagtttttttgccacccagatttttgcttgtaggaattaaatcctgccctaaatggttctgtcagactatgttccatgttctgttctctgttccaatggaaacatcaagctcactctattttattaaatgcacgtcttgtttactacagtaattaactttagcatctctttcaattataaacattttaggtttacacattcaacttgtatccatataatatgattcagttaaatctaattttcatttaacccagaaataagtaacgtctaacataactccattaactcgtaaagaaggatgctgctaaaatggccatttgagttcaaaaatatgatacttcaattcgacttgttttgtttagcttcttgtgagagaattccgtccatctggcagccttataataaaattcaaccaatgtcactatagtagataaactttattatatatcatcgttactgatttgagcatcaagactattttttttaacaggtatccaccctatccatgatatctcaatcgtatcacagattaaagagtgcactttagtgagcgttaccccagtcaaaatcatcagctctatcttgaatgcgctttttataaaaataaagtgttttgtattcgctctgtgaaacatttgtttttgggctttcataagctcctgagtggaaacttgagcaatgtaaaaaataattttggatttgtggaaaagttccctttctaaaggcgggtctggaaaaagaaaacacggatagtttataaacaaaatgacttaaatatatttttaatttttaataaatacttaatttttgtgtttattttctaataaatttttattttacttttagtccctaataaattaataattttgtttttagttaatgacacttatttgtaatccattataaattaataaattttgtgtttgtttaataaatcttttttatttgttattagttgggactaaaataaaatttattaatttattaaaaaataaatacaaaatttgttaatttattaagaatgaaaacataatataagaactgaaaataaaaatattattttattaacaattcacacaaaacaaaattttattaaaaaacaaacataaaaatcaaatatttattagaaataaaaacatattttaatctaaagaaaatttgtcaaatatcttttaacctttcattatctcttgcaattcaaacacacaatcaagctaatccttattactttgtttaccttttttatattatatccagaaagaaaaataatagagtgcacagcgtattattgctgacatgttattcgggttaggatcagctacagttttgttaagaaactgtatgggatctcatcccttcatttaccaaactatctttaatatttgaaaacctcgtatatgacattagtaactgcattgggttcaaattttcaagccgcagagatctaattctcagttatgcttatttaaagtggcagattttaatgtgtgatagatagaaagaagaatgcttacaatatactcattttaatatatatatatatatatatatatatatattttatgagttaaaattgattgcaacttggcttgaaaatgtattagagaggatatttacagcatttctgtgcaaggaaataatgtatttaacaggttgtgaatgaaataaaataaaggatgtttgaaattgatacggtggcagagtcaggaagggggccacgtagcttcctttgttgaattgaaacgtacgtccttctcaagttggcacaataatttgacaacggatctccaagaaatttatatgcggcctctttatataaaaagttatttttgagagtgtttctattattaaaaatataatttttttaatagaaaaattctcaaaaatatttctaatcttatattcaaagagatccataccaaacaattctttacttgacatgagtcaagtctttatttctgagaaagccaacgaaatcatcataataaacggatacagagcgctaattttccacaaactttaagaatgtggccctacataaacatttgtccttcgttgataacaacatgcatcagtatcgttcagtctaacttagcatagccatgagcactccatcactctcaacctcaacttattctatttttaatctatgcacctttccaacacacggagtaacatccaacaactatcctcatcgcaccatttttttatattaaatataattaaaaatatatcttattaataatcatgatggttcttcatgaaaaaataaattatgtctttctctctctaataaaaccatgaactaatattaataaaattctctttaagaacttacaaaaaataagtgtaaaataaatcatttttatttatttataaatgaaaaccaattaatttatgcatcttagtttttaaataagttagatgatagagtttttaaaagaaaaaattaagtaaataagttaatttaaaatctattgtatttatctttttaccttttctcttattcataaatattgttaaagaattatctaaaactattcaaccaatatatcattaattatatattattcaagatctcaaattgaaatcttgtaaataaaaaagtgattgaaaaaggaaaccttactaacatgactaattacatcttcttctaatattacttactagcaaaatcgattaatacttcttagcaataatttggtgactccaaatatgtcatataattaattatgaataaatagaagtggatctaagttcctttagttatattttagaactttgtttgtcctaatttgtccatgttttactatataatttgacagcttaaaataatttaagatctaggatcaaaacacattgccaccttatatatccgagtctctgtcagctttagtctgtttgtataaacttttttagaaatatttataagataaaagataaaaaagaataaaatgaaatttttcttaaatttgaaaaaaagaaaattcgaagatgtgtgatttgatccagatcaaacgggttatcaatttgatgacaaatcgtgtgaccacgaacccggttggttcacaccttctggaactgattttcaaaacatggctaaaaaaaccgcttagacacgtacatgtacacactttttatatatgacttttaggacttcgttaaaggttttttgttaaaccttttaatgaggacttcgttaaagttacagcaaggagacatgtataaaaatgaacacaattgaattcaggtcggaaaaacaagacaatgcgttaaagcaatgtacctaaccaaacttttttcccactaagaaaataaaaatgataaaaaggatagttgggacacttccacttgggagcgtggcaacaatgtccaatctgttttatagtttggataactgactaatttcataagttaagacatagagttcccaaaaatggcacctaatcctatatacatcttagtggcgcttcgggacatatggcttctcttctatctccatgtcccatttttcctctccaaacttattccttctctttttttttcactatttaataattaatatctcttacacttgaaaatgtcacaaccaaaatttcctcgtagccaaagtagagaagaatcataggcaatacttcccataatttttagcatcagtcaccaataatcctgacaagaacatatgccaccatcaaaatggtgaaatctatttgaatctcgtaaaattatctgtcgattaacaatatttgatatgtatttgaaagcagtgtgacagtcaccacaaacccgaaggttcttaattatcctaataggtagctcagattggcgagtgagaacaaaagcaatcgctagtttctcactatgatagctgagaagctcttctttgttttcaagctcaagatcatagagtgcatatttggtttcaggcacatatcccaggtccctcattttgttcattatctccttgagtttatcatagattttttctttttctgggtgtgtttgatctccagccacaaacacatgaactccatccttcatggtgacccaactacacccagcttccttcttaactgctgcgttcctcattgccaacctagcctctgccacatcttcccacttcccaccagcagcatgcatgttagaaagaagcacatagttcactgcgttcagcggctctaactcaataagcatcttggcagccctacgccctagctctgtatttcggctattagctcgacaacatgctcctaaaattgttctccaaataagggcattaggattcattggcattgttttgatgaactcctccagcttcttaacattacctgcccgcccaaggaggtctaccatacaagagaagtgctctattcgaggagctagttcatatacttcacccattgatttgaaatgctcaaatccttcatcaactaaccctacatgactacaggctgataggaccccgacaaaggtaacatgatctggcaattggccatgctgtttcatttgtgtaaaaagcttaagagcttttcctccatgtccatggcgtgcataaccagaaatcattgaattccaagaatatatgttcctcacaggcatcaattcaaagaatcttgatgcataatctatctttccacattttgcatacatgtcaactagtgcactaccaacaacaacttcagattctaaacaagctcttatggcacatgcatggacttccataccacgctctaatgttgcaaccgaagcacaggcactaagaacagtagcaagcgtgaaatcatccaatctttggcccctttgcatcataagccataccaaatccatggccttatgcaggatgccattgtgtatatatccagaaatcatggcattccaactgacttcatctcttcgctcagacattctagaaaagataatctcacagtcctccatctgctcacactttccatagaaagctagaagtgtattctcaatagcattgtcatcagcgacagagtgctttaagattaaagcatgaatttgacggcccagttcaagaagagaaagagaagaaactgcagataaaatatttataaatgttactctgttgggtttccatccagcttgcatcatctccaggaaatattttatagcctgtaaaactgacgcctctgaagttgctagtgcaccaataaaagaattccaagaaacttgatcgtactctggcattagaaagaaaactttctgacattcccccatacaatcagtttcagcatataatgttagaagagcatttgaaactgaaacgtccaaatcaagcccgcatttgatcccttcaccgtgtatctgttgtcctaacatgatccaacccaaacttgcacatgaactcaaagtactaataactgagaattttgatggcaccattctatttctcctcattgtgtggtaacatgcaactgcttcctcaaatcgctcattgtggtcaaggccagagattatagagttccatgaaacagtatctttactgggtatgagttggaaaattgaccgagcattatcaatggcattgcattttgcatacatattcacaagagcatttccaatcaaaatccagacatcaaccatggcattgcgaatcagataagcatgaacctcttgaccctttctcttcccttcctttaaatttgaaaattcagtaaaagcacttaaaagaactgcataagatgatgcatttatttcaactaaatctttcatttccttgaatatcttagctgcttcttcaccctggtgctgccttgccagtccaaccattaacccattcatagtcactgcattacgatcacccatctgctcaaaaatcattttagcagaatctattaaaccataccttgcaaacccgctgaccaatgcactaccaacatacaaatcttgtacaaagctagatttttcaatcctggccagcatctgctcaagcaaagtcagtccacagtcaacccgagagcatgcaacagttactaagctacagaaggtatattcattaggcctgcagttaaattctgtagcttccctttgcatgcttaaaaatagcttaaaagcagaaattgcttctcccctacgacaatagactgaaatgatagaattccaggatgcagaagttttaatttttatttcatcaaaaacacgaagggcatcatcaatggaagctgagcaatgtgaatacatggacatgagcacattagacaacaccatgtctgaagcatacggagatttggaaattaagccatgaatctccatcccgagtttaagcttatttggaccaagctcctggcatgctcgaagagcactaccaatagcatagtggtttggtgagagaccagctgaaatgacccttctgaataacatacatgcctcatcaggcatgccattttgtgcatacccagaaaccaaacaagaccaagaaacgaggttcttttggggcatttcatcaaacagcttctgtgcggaaaccagattgccaactctgacaaatatgttgataagagtattacaccagaaaacatcactggtaagcccagttttgtagatctgcagatgaagctgatgggcatctttcacgctgcaagaatctttgtatcgattatagtccaaattcaaaggtggaaattggaggtgatggtgagatgagttgtagtaatgtagcaactgctctgacaaagctaactgggtagaacaagcatgacttgcattgtgtaacaatcgcctgtagcagagtatcatgcttttcgcaactctaactaggaaatcatttaaccgtttaatcacaggatgcttgtttacatgtaagtggagtaaaaaaaacaaaatgctgccattgcaaactcaaaattttgtaactgggaggggaacaagggttatagtgataaaagaagttatggttcgaatcttctggctgacttaacatactaattgtgaaaatttatcaataaaaataaaaaatttgtaacccctccaaattagtatagttatccttatgttcattatagatagaatagtttgatcaatatttaagtttgattattgataaaaaaaaaatatttaaattttatttatttttagtcgaattttaaattaattgttaaatcgaaggattaaaaataaaatatattataaacaacaaaactcaccttttgcatattaataaatcttacctatttaaaaaattcaaaacctatttgatatttatgaatgaaaagatacttcatttgatattataattttatataaatctaacatggactaaaataaactaatagaattaaaaaaaaaatactatataaagttaattataatctataaaaaaaaaatcactatgtctgatgataaataaataaactaagtttaaaaatatgatatgagtttatttttaatgtttaatctaactttgatgataatttatttaaaaaatctattttataataaaacttctaaagctgtatagtccatatttttaatcacctttttgttgttgttggcacgatattcttaataagtttttttcttttaaattaccatattctatatctttgaattgaatgacaataatttttgcaaaagaatttatatatctaaagtatttatttattataaattataaatataaaaaataaatatttaattgtgcaatttacaatctagaatactaaataggaagaaaaggtaaattagaataaagaagtgggtgcatggacgccaggtcattagctgggtagataagggtaggatccaagccaagagaagggaacatatgtgatgacattgcatttgcagcacacaaccatcaacatggctgccgagctcactctatcttctcccttttccttcaaaacttcatttctgccaaagtcaccatcattttccccaggttcatactcccccagaactaatgttaccgttgtcaaagttcatgctaaattaggtaacatacatgcaatcactcacttccctttgcttcagttctatgtaactattatcccatccttgtgaattaaatgaggttgagatgataaacttaggaatgtggatctgatcctattaggtggtggagatgaacaagccaagcaaggaggaaagaagaaattcataaccagagaagaagaaccacaacagtaacaattcataatttttattttttccatttccttaattttctggtcaccacgtatgtttcccaaagcctttctattgaatttgcgcaggtattggcagacagcaggagaaagggaaggagagaatcccatgaagacccctcttccttacattatcatatttggtatgtcaactccttttgtaatcttggcaattgcttttgcaaatggttggattaaggtacctgttcgatgagacagcacttcgttgtctactctactcctcgatcttcacatgttaattcacgaattttaagctctttacttctcattctcaaacttcagtagagaacttgtttactttttcacatatatgtatggacattatattatggctcgttgtaatgaactagagttcagtcctaccactatgaaagtcggattgaaaaagctacttcagagtagctgtagcagtttgataacccttgtacgtttttagattgaaaacaaaaggagaagaatcaagaacaaataaggtctttttttttttaccctgttggattcgctgcttcttgtttcaagaatagcacacgttgttgatcaatgcataatagttattttaatgaccgaacaccgaactgctaagatgagatggttgactgttacatggaaaattaacaaaggaatttagtggttcgagatttttatttctttctgctccttgtttataaaacaggaaaaagaaaaggcaaagaggtttagatcgttggtatactatagaactgcagttttttcatatttaggagaaatatatggttgacatctttatcatattaggttatttgcaatattcagacgtaatgatgtatagtgcaacagttgtacttaaaaattaaatatgaccttcgacactgagcaatctgtaacttttatagagagaaattattgcgagtaaaagtaaagaaatgtaatggtctgtggaattttaaccaatatgaaaaaaaggttagcctcatttatcagaagtagaaagtggtggaaacaagtgtactcagataacagtagtgctatgcatagtatgaacatttaggtgtcgaatttagctctctcccggggaggaattgccatttaacttctatatatctgtcccttattttaaagcatttaaatgactcttaatgtatgttcaagttcaaccatcgaaattacccatgatagaacctgggcatttgccatttggcaatgggtcggtttcagaagctgatgacatcatctgagagcacaacagagaagaggggaagaaagtcatagttcattagtgttagccattatatgctagagtaaccattggatcttcatcacagcatgtgcaataagctagcatatccaatttcaaattgtgagaccttgaaatcaacttgtcaactactacgggtatgttgcttataaaaaaacactactatgaaatgtattgtatatattgactgcggactgccagaataaaataatattcccttaagttttttacattgaaagcaatttttcatttacctattccaatcaattttctacacattagattaatgaccttaacaaatgttctcataaaggcagcttaaacgaggcaagttcaatagcaaacaaaaatcttaatgcttcatcatctttccctgcgtaaggacttgtacagttccgtagtaatatatttgtgttgaaacttataagttgatcgtagtgccccaaattgatccctatcagttttgtagatgtatagatgattcagttccaaatgcgtgggcctagggacaagacgactaccacttgcggatgaagaagcctcatgtcttattgccactggtagttgtggtggtaattctggcgggggcttgctgaactcctcttcatttaagtatgtgttatcataactcgatggtggtgatggaggatcttcaaaatcggagaagtttggaactatttctgggatataatcctgtaaaaatggtttaatcaagaagctaggtgaggctatctttgtatatatagatgaattgctcgagttgaagggattgtaagttatgaccatatttttgggatgttaattcattcaatacactattatgtaaacaaaattttctagcaatggatagaagactgttgaaatcaatctaaacaaagaaaagttacaatccattactatgaacttgcaaacttattctataagtgaggtcagagtcagagtcagaattcagaactagcattagttttttatttttttgttcagccagaactaccattaggtaaattagaaaggacacatatattcctaaatcttcccgtaagcaccgagcaattaacaaacaaggttgggacagtaacgtagaaattttctatctaccatgccatatgaaattctacttctgtgccaagcatgcagctctatagtctattctagtttagtatgagaccatccactcaggcatgatgagtttcctcatcagacaacaaattttgacaaaaaatgattcaacgtgtgactaaatggatttagtaagtactgctgaataaatattgtcaaaataaagccaaactgtcaactgaattgatgatcgtgttaaaggttatagtaaaagaaaacactggtgaagatgtaatcaacatgatcatcagcatttcctgaaaaataaactaataaagtaaaccatgaaattacctgcaaatccaatatattgtagccataacctgaatcatcagaagccgatgggaactctggagcatgtgtcaagtagccatctacaatgaaacggtaatgatagatacctatcgggagtgttttaacaatgacaaaattttgatctactctcatcagaggctccctgacaggacaaggtaaaaagttcatcatatcataagatgaagtaagagcaagaactatagttggaatttaaaattgtgtagattgttacgtggtctcccagctatcccatgatcctgcaatagcaacattcgtggctgcatggttccatgtgatcctcacacttttcagcctttcatgaatcacagattctacatatccattttgtggcaggggttgcgctaccgctgctggtctttgcatttgcatggcagccacagggaccttgaaaacaggcattttaaatttgatgttttaacgtaaacgttcattgtgttgtgccgctcaagatatttactgtcaaagtagcttcattcaatggcactaactattaacttgtacattcttcatcagattaaaagcattaaatccttattgtaattgcttaaatttttatatatattacctgggagtgaactaatgttgcaataacatgcatgtattaagtctcattataaatttcttcggccaatacatctcataacaattccctataggaccagcagtgtttcccatatgaatgataaacaaaattagtattcaaaatattaaatccaccttaaaattctaaaacttgaaagattactttgatctatgccctataacctaaaatctgattttagttgtaccatcccaattccacaaatcactattaaacggtaaaagcagtctagagaaggctgagaagcatcccaatttgataggatgcttatttcttactgctttgatcaaatttctttctttcccctcatggatacactgtataaaactataacattaaacacgacctgtcctatttatttttttcaataaaagacattaacaaaggatcatctaactctgacctggggttgtatgagcaagggaggtggtggctcatatggtccagggccatgtgaaggtaactgaaccaatggatctgtgaatccattagtattgccataaagcacttcaggtggcagaaatttgatgtcttgttcgtactcatcctttttaactccagaagtgccttcaccatcctttcctctgctgttactacccatcactgaaagtggaagaaacccagattttgatcgcacagcacgaatccattagatagagaagaaagaatcagaaagcaatatggcatatccatttcagtgcataaatagaagaaacccttgaaagcaaaccaggaattgactctaggtagaagagtggcattgttgttatagaaaaaaaaaatagtttttttttgctttattttaatatttgatgagcctctcactctctttctctctctgaggatgccacttttccctgccttaaagcaactgaacaagcaagtatacagggttttattctccaatgaatttggaagattccgctgtggactaattattatgagtctggtttaaaggagaatgttcccctgctatcaggaacaaccaaacactgtctaatgaaacagtgcatactttttgcacagtttcttgtccctgtgccggtccattaaattaaattaattaaatttctgtttgtaaagcaaagcaatctaacactacagaatattggttcggtaccataatggattacaccagctaaacgaacttgttttcagcgtaatggtattgaagtcaaaagctcgtaacttgctacttgttactattattgtcaactaaactcataaaatggcatcttctaaaaaaataaagaaaaaagaaaatcataaaatagcatccattgttttgtgcttcctgtctatacaggaaaacatgagttgttggattggatttgacatgttagctttgtcttttttctattttgtttgcaacttcttgtcttgcataataaaggttaatcatttcaatactagtgcacttcttttgccaatgacaagagtactgcacatcgacaacccatcccatgaatagaaaaataaaagcctgctccgtcctcttggttgaagtttgatggttcaatttcacgatatactagaaaacaatatgacactaaatcaatagtttatgaaaatataatattaaatcaataatttctatttcaaccctattgtcaatttagtataatatacatattccttgtgaggaataaattattttttgttgcaaaggatatagagaaagggatcggtacctgtgagccaaccactgtatttcatattcatgtttgtatgttgtgattatttttatttagttacaagtaatgggtaatcagctgttttatatcatatagtacatcgtatcggataaacaatgcataaagagggctttcttgtattagaattcactaggactaggctcttgttatcgaatccaacgacggttttatctttttctaatgcgtctgctcccttgaaacgaacaagaaattgcgccatcatggctttatgttagagcactctttctgcagggatgttacaatacacttcattggaaattggccccttgaaccatttttttccgtctacaatttcatagctgtaccaaataattatattatagtcgcttcaatcctcaaatagatgtagacctattggctataacctataagggaaaaatcatgtatgtaaagtgaatgagtaaaattaattatatttatttttaagattatttaatacgtacgtcaaaatcatgatggattattaaattaaggattatttcactcttaatcgttttaagcaaaaactcactttcaaggggcattttctaatgtataataataatgaaaattaaccaagggctttcattttctacccttctcctgttctcctatagggttattaacattgatgcatcctataaagtatatatgcttagtgaaagggtgccaaacccaaataaattctccagggacaaaaagtagatacatacggatcttttccattatatagctgcttttggaatttaagatgcaaccatagcatcccaagattccaaagttcaaacaaccatgtgaaaagctaagtaaaagcatcaatagattcttgtttaggccttttgaagttatacaagtagctcctgcgtgcccttcatcaattccacccaactttagcaaggcctctatgtccaagtccccaaagtatctaccttcccatgtggtttgttttatatttccaaaaggagtcagcataataggtactagttgagcatgtcttaatccactaaagctcgtgagagcaaattatggaggaagtgggcatctccttttaagcatccaatcaatgataacaagctcaaagtaaaacagatggtagcatactttaatagtttcacagttacttgctaggtgtcaactaaacattacataataatctaacaaggatcattatcttcaaagtttacagttttttttttttttaaaacaggtggaaaggtttgtaaaatttgttacttcatagttattactatatgctagcatagatttggtagttgtttgatgcatgatggacaatcatatgttctgtggtttgattcagaccccatttccttcataaagctaatcaactagatattcctccattcccacatgttcgtcaccaaccactgaataattaattaatcgagcaacaactctacgagtgaattaatatttgaacattcattttaataaaattgggagctccgtcaaatttgtgtagtggaagttataaaaatcctttctcaatcttcgttattttcatgaaatttctcacctataaaaaatttaatataaacaaggtgtttatgtttgattgagtaaatttaggatgaaaagaaaatgaaaaaataagccaattttctatgacaagaaaaaataaaaggaaaataaatgagtctcaaaaattgaaaaaatgctcaatcaatcaatcatgttgttgctccatccagtgtaacatgcttgtaataaaatatgaaatgatatgaaaaaatcttcaccaataagtcataaatcaatcacataaataaattggacatcacatctaactcaaagttttaaaacattagatatataaattcttattacttgtacgttgttcaacatactaatcacgttaacatgacttgtattaagaaatgaacatatttgttgctcttagatattgcatcaaaccaattgtcaaagggattaatggagaattatacctatgttcatgttaaagaacacactcattgaggagttataaagtcagttaagaactcaagaaatccaataaggtgtactatgcatggcttgtcatgatcaaggaaaatcacacctatttatagaatatttcttctaatcgtcttgtaatggttcttgcccttttttagggatgacatgtattagtgaaaggaaggaggtgtttattgtgccttaatcatgtaaaggtgaaactaatttagggatgacatgtattacttgattatgtattagagttaggtccatcaaaggacatatttgtgactatgactaaacctttatctttatcattctaatttatagtttgtaaacatttattatttattattagatcaaatggttttttttaataatttcatctgaaaatctattattcttcatcaaccgttaaacttaaaagacatagatgcttgttagtcttaatccatgatactatttatttctctcaataaaatagaagaatcatattttgttatgaagtttattaattgggcttgtgacgcatactcagtaaggggggaaacgccaaaacatcattatcttgccttatggaataagcaacttaaatagttgtctgcttcttggcaaagttgtgaaaatttattttattttatattctctctttttaggttaatttattgttaaagtcttctacgggcatttgcattgtaagcaaaaatgtcaagagagtgactttgaaataaaatatgattttgtaatttacacaataagatcggtcaaataaagaagcatgatagccaaaaggccaaaataacaaatttgaactaagcaaatgataaacaagcaagttgctgcctgaatagttgtttatatatatatatatatatggcttaattattagtccttgaatttgaggtgtgtaattttttagtctttgaaatttaaaaactattttttttaatccctaaattttgaaaattacatttttttaagtcccttacataataaattgacactttataatgatttttagttgttttaaattaatttttatttttgattaatttgaatttgcatttaaaaactatcataaagtgttaaaaaaatttgtcataaagtacttaaaaattatcacaaaatatcaatttattatgtcagaactataaaaagtaatttttcaaaattcagtgattaaaaaaatatttttaaatttcaagaacaaaaaaattacacaccaaactcaaagatatataaatataaatatagtatgaataatatgagaatactcttatataatcataaaaggaatttttataaacatgtgaacaacgaatttaagattaaaaatagttagttaagatgaaagtatttataaattcaaattaaaatttaatataatcataaaatctttaaaagattttttttttaaaaatcaaacctataagtttgttataaaattcttttaataatgggtcttagttgaatgctaacacagtgattgaaaatttggaaaatttacattgtatttagggattcacatctcaactacaatacaaattaaacaagatcgtatataggttattatatatatttttaaagccaacattttttattttattataatcatgtctcagttttagcacaagaagtgccatacacgaagccaaaaatctgctcacaacagaatacctcacctctttcgaaaaggcaatacatagagacatcctcccgaaaatgaaatatgctacaaagccacaaacatctatttttcctccatttacaaaaaatataatctaaacgagactatgctccccccaacacaacaaaagatatccatcgtatttttacatctaacttttctttcattgtatttctatctcatttttatatttctttattatttttaatcatatttgtcacgtcaatcatttctctctctctctctcacttatacattccaaaaatggaatatacattaaacttttacacacacacaaatatatcaaacaaaactcttcttactatacaaaataagaactataaatacagattatcaaatcatatttcaattttaaagttttaaaaaaatatctatacgactttttaaaatgattatgtgtgatcaccaactatttttttaataatcaataattaattgtatcatatttaatttgtttttcatataaatgtattttttatttgttcttagattatttcaaaatggacataattatgaatattttgaatgaaacttgatgtttctatatttattggatgaactttaatttttatgattagctttcttatcatctatttcatgacatatcacacataaataaagttgaattttttgttgttgttagaattaatgttacttgaagatttgaactcatgattttttttactattttcccttcaatctttaaatcatttttttcaacatcaaatcaacattataactctttttaaagttgaactttttccctaacttcgataataccataggcataaaacattattatgtaattaactttagaagtatggtcacgaattatcatcttcttagcaaggaatgttaaggtttgaattttgatccattttgtagaaacatgcacgattcgtttatcaccatacgtcacttaattggtaactttgaattttctcaatccttcgaatgccagctttcatactacaaataaaaaggatattgacgcataagctttggattcaaagcaaggatgttctataagctccgtggttagaataaaacaggtaataaacattataatatggtatgttaaacatttttcaaatgaaattcatgattagtggcaaaacatcccctatttccatccctcttcatgacaatagagtagtcgaattttctttcttgtgtttctttttcaagaataaagttatattctcaaatcccaaaaataaagtatttataaaattgtgtcacacgtggtcttatttctataaataaaggatcaatggtaaatgatttttttattataaaggacaatgactacatcaatcatatttgtataaatgagagattaacaagaaaatttgtttttaagggatcgaaagtatatttaatttattttacttgcaaagattaaaaacatttaattttttttatagtaacatatttaactttaattaattaattagagagtttaagagtgagaattttgataatgtgttataaaacattcacttttttacgcaaatgactatatgtacaaatggtttgcaaggggcatcattaagttgttgctttataacccaaatagcttgaacttgagtagccagcccattgaagcctggacccggtttatgattctccttctttaatattaactgggcctagtaaatcatggatctagagtaccaaaatagcaccttttaaatatgtgcttgtttggacccaaaacataaaaaaccgtaccttgcccttgctcctccatatctatgctgtgacaaatattcatatgtcctcatctcgaattctcacacagaacttcgaaccttgccctaaatagaaacgtacttgaattccacattatattttctggtatcagcatactaactagaggggaatggaggtacatctagttgtcatcttataaacataactgattcatttttttcccctttgggtccataattacctgattttagacaacttattgcatcaattcataaacctatgctagtgggatacctattatatatcaaaccaactttgctttaacttgcttcattgtagaagctagatctagcatacaagtttcttatgtattttgtagctggcttgttccgttcaaactttcttaaatcttgagcatcaccttatctcttttggctgacattgttgcagttaattttaactttgtttacttatcctaaaaccaaaaacaaagaaacgaatcaaatgtccttgggtagcttttataactttcttttgagtaagacactgtttactccgttcttaattgagcaacaaccttactgttaaatattgaaacagtacaactattggttgccccacaatgatgctatttgatgctttttattccaaatttggtggctcggcctttaattattgcaaggatgagggtgacaactatgtatcaaccaatgtaaaacataaatttatttgtcacgaacaatgatggagcccttttcactaggaaaaataaaatgcttgaactggtttattggaatattgagccaaattgtcccaactggcaaaagattttggtctttataaatgattttgccaccaataataatttcaacgtgttctccagaggactgccgtcattaatattacgcaaaacacaatttaaaacatagatatacattagataggggctcctgcacacttgcacatattatacatttttcccaattatctggctcgcattacagtaccctatctaaggatgatgattaaatttaatacacatctataaaaattgtctataatggataatatttttacctattcatgtaggttttaatctagatatgataaattttttttgctgactttattcacagaatttttgtagataagtaagtgtatgagtacaataatacttttttttaatagtacattaatactataataactgaatcacttcatgtatatactcatattttttttaatcatataattagtgcgaagtatgcaagtatatatacatatatattataattaggatttaaaatattttatatatttttaattaagttagatgttatactatttattattatttttgttttattaattacatataatttttctaaaaaagtcatataatttttaatatttattttatttatttgtcaaaaaataaatattttttttattgagaatgaacaccgacactaaaattattacctttacaaatataaactaaagtacggatttttatttttaaaaatacaagtgtaaatcactcgtcttgaatccttctcggttattgttcaaaatgtatgtattatacgagatattttaaaatgaaatgaccttttgagagaatttaagtcaaaattcttactaaaaaatacatttcactcagcagctagccgaaaatcaaatgttatattaaattaaaatttatgatcatactatattataaaataaccacgttgaaggatcaaaagaaaactattatgttttttttactaaaaaaagttgtttttgctgcttatctttgaacaactttattaaagtcccacgtaatgaatcataaattaatgctaaatgaacataaaatttattcgttaaactaaaactacaaataatctcttaattaaacaaaataacataaaatttattatattatgaacaattaaaacactatttcatgaaatatattttctttttatttgatattttttagttttttaatctgaaagtatgtaataaatattttttttcataaaaaataattaattaataacattataattttatttcatttcactttatgctatattttattctatttatttccacattttattaaaaacatatgcaaacatgattgtagatttgctagtgcgatgataaaatttgattttgcccattttggatttacgtaaattaatagtatttggtgttttttttattgagaaaaatttcaacgtcaagaatgctttcagcaaattaaatctcaaaggtacaggacagtgtgatatttgtcgtcatcgttaacaaacgttttgtaacattttttttaatacgcttttctatcatcaaataaaaattataaaattttatagatttcgcttcttactcaatattttaaatttattaaatactccttaatatgtatatgttaaccttgaacactaacacttttagatcgaaaatagtaccagagagcgagcatccaaattccaaactcctcttataattttaagtttaattttttttcttgcaattcagttttttagtttttttttccttataactttttttaaagaataaaaaataaaataaacataatttataagaactaaaaattaaaaaaataatttataaaaataaaaaattctaaattatcaaaattaaaaatatatttaaattataattttatttaatacaaacaaatattggcaactgtacttaaaagaggaaataaaaatcgtgaaactgacatgtacattagtggggagtggggcctaagagcgtcggtgggatgcggatgcccaattgctcaattagcccactttgccctttaatactatctcatctcatattccagaaagagtatataatactatctcatacactgttttatacaatactttttacttacttatttattatatctcatattcctctttcttaattatataatttacaatttcatatttctctcttaattgtataatttatcacaagagtactatttttcttcaaaagaattactatttttataccactcttcaaaaagttattaaatactactaattcaaaactttatgtatccatgattctttctaatcttcacatttcattttgtcggaagtattagttgatttggttgatgattaacttttatccaagaaatttgaacaactaattttaatgaaaatgttttctctcaattacatcaaaaaaatgtatttatagattgtttattaacaaaaaattctcatattgatatatggatatgattcttaccgaatgaactaactttgttggttctaattattaattttcttctaaattaaaaactcaaacacgtattataatataaatattataaaaaagtggggccaattaaattagttatcttaatagaattgtcaaaataatggaggatggggtccatctcgaagccaatcccaagctggcattaatagtatgccttctcctcataaacggacatgctgctttagttataaacccacacactcctctcttctccattctccactctccctctctctttctttccctaatcctccaaacaaaatgaagaacctcttctctctcttcctcttcctcttcttagcctcctccgccgtcgccaccgtccccgcccacaacatcacgcacatgctggccaaacaccccggcttctccaccttcaaccactacctctccctcacccacctggccgaagagatcaaccgccgccagaccatcaccgtcctggccctcgacaatgccgccatgtcctccctcctcgacaagcacctctccctccccaccatcaaaaacgtcctctctctccacatcctcgtcgactacttcggcgccaaaaagctccaccagatcaacaacagcaccaccctcgtctcctccatgttccaggctaccggctccgcctccggcaccgccggctacgtcaacatcaccaacctcaaggccggcaaggtcggcttcgccgccgaagacaacgacggctccctccactccttctacgtcaaatccgtccaggaaatgccctactacatctccgtcctccaaatcagcgcccccattagctccgccgacgccgaggcccccaccgccgccccctcggacatcgacctgatctccattatgtccaaacaaggctgcaaggccttcgcggaccttctaagaggctccaaagcccttccatctttcaaggaaaacgttgacggcggcttaacggttttctgccccaccgacagcgccgtcagcggtttcgcgccaaagtacaagaacctcaccgaagcacagaaggtttcacttctgttataccacgcgactcccgtttacgagtccctgcagatgctcaagtccagcaacggcatcatgaacactctggccaccgagggagcgaacaagtacgacttcacggtgcagagtgaaggagaagacgtgaacctgaagaccaaagtcaacacggccagcatagtggggacattgatagatcaagatcccttcgtggcttataagataaacagggtcttgatgcccagagagctattcaagcccagcgatgccaaagaccaagaccaagcacctgccgagtcgcctaagcctgccaagaagaagaagaacgctaagaagggggccgccgattccgatgcggcggatgcaccggcggacggaccatcggatgattcccaagatcagaaggctgccgatgaagacagcaatggagtaagcggattgcacgtgagattcctcatggtcttcttcggtttaattatgggctttttggctctatgaaacacccatacatatggattatggagtgtcggtactatacacttgtggtcaaccatcattgcaattaagattcttttctttctttaatatatgtgaaggaaataaaacgctgccaccgacacatgtaggaggccatgtgtacttctttctttctttttttttttaatctgttagtattataggttttgtatttattgtttgtttgttttccgaattatttaattggcctttttttccagtgtgggtagatccggtttgtgctacctgccagctatgggatgtgtgcatataaacagttttcaattcattagattttgatatcaatattcgcccctcatgttttctttattattgttattatgctacttgtcttaatttccgcggtcacccaattagtagttcataataatctatgtttttcggacaccattaatatattttaattttctaagacattaagctcggattttgtactgtaatacgacattggcttaaggtttgaacttgctactgcttatgagttacttaaatcatcttcaatcggatttttcaagtgaataagatatgtatctcaaaaataatatattttctctattataacaagtccatgtgataatgaaaatagatatgtattttttataagaaattattttttaataataaaaaataatatttatctgacccataataatgttataattaaaccataattaaataaaatataaaaatatgaattttttaaaattttctagaatttctcatcattaaagaaaaattatttataactttttttataatgatatgacactttgaaaataaaaaaaaaataatataaaaattataaaaataacttaaaaaattctcattaaatatcctcttatcatcttatcactatttcagttctagtagcaacttgaattaagagaagcttatatagcgaggtaaccttttttttgctgtaatttaattaaatttcttacagtttcctttttatttaaatgtttaacggcattttcctctaactgaatgatagaattttaaaaatatggcccacccatcgatcaaacttgtaccttatactgattatgcagtggcagagcattttaatcccaaggagatattgttttccaaaagtgataaaagaaattgaaaaatcaaggtttaaaaattttagtcgcaatatcataattttggaggctttctaaacagcaattattgcggtagctgctcaagttgtcctcaattttttattttttagttttgataatcataacgtaatttcaaatccgataccgatagcatccacaatttaaaactgaaatgaaaataaaaaatcagaaattatcagagtcctgaaccaaaccagtacatgatgtatggtcctgatcaaatcactatatgagactaatcagtattattaatcaagctaaatattggacacttaggccaagcccatttcatatttatatcaaattggttttgatccactaatgttaagatttaaagcttcttctacagagaatttgacaaaatagaactgagtttcgaaaagttgacaaaaaaaatatttatgcgtgttaggggggtgagaaggatgaaggatctcccattaactttgcagctgagtgtcatatttcttgacattaagtgagtcattaaagtaattgcatagacaaagattatacaaatttgcaaagaacagaacataatcagcggtgaatcggtgatggctaaagattggaagaaactttgtactagtgtgtattttagagaaactcggttagtgctagtgcgacgtcttccttcccagtatccatgtattgaattgaatgtaacctttggctcgagtcctaatcggttctgtataggagatctgtagctgctttattagctactttattacattccacaacggatagtgtaaaccgatatccgttatatgcagatacaaatttacttcagcaccatcactagtcttttcacctgtcttcattttttaacattcatggatatctatgggtattcgctggtatacaaaaatccacaggtagttgaattcgaggatatgcgtgaattcacgggacgggtacggacagattttctaactcgcggagcatgtaacacgtgcccctatctagtggtcaattcacaacaaccaaagtatttgacttgttcattacataatttttgcggtgaacaaagggagcaaagttcaatgtgctgcagagggtgaatacatcctcgttgccaagaattcttttcaccctcaagattacaattttctataagcaaaaccaggatggagctgtatagccggaaatattgcagatatgagaaagaaaacgttgccaagaattgcgaatgggaactttgaactatagtttcacttatatagtatttataaaagagaccatcactgcaatgtgcctacaattttcaagtctcggaaccgaaccattttaaagtaactcagtctggtgtctgcagctgccaaatcagcgctataaacacgggatcaagatcccctgcagttttttcttttccaactgcatgaatctcaattctcaatcattaatatatatttctacttgaataaaattttgatagaaaaacataattaaaaaagaatggattgtgaaagattgaactgcaccactgcacggatgttactgcatgacctacagttacttattaaatgctgagaatcctagtccatctcttctgaacctgagactttcggatgaaaccgtacaaaacaccagaaaaaaaatcctcgtactaacagaagtgcatgttctttttagcatcttattctactagcctacacttattttccacctcaaaaatttctgatccaagattaggggtcccagatttcaaaaacaactttcttatatgacatcatccccattaaaaaaaatgccgtatatgttcaacttaatattttggctttagctctcggctctaagaagtgaattagaaaatcggcagtcctctacacaataatagatgacattataaaattaacaaacagtagaatggcaccatattttatccttattgaagacataaaattcaggttccggatgcacctggaaaaagtactaacaaataaagttacgtatacagcttgaagtaagtactattaacaaataaagtttgagtatgatatataaatacctctatatatcaaacattttattaacatctattatttcagtctatttttctctttttatcacaaagtattatatatactttatctgtcttttctctctttatctatctaggatctaggtgtctactagagtttgctgtccacaaatgttgttccacaaagtttacaagtatatgtaacggcaacttgcaagcatatacatgtcaatcttgctcctgtttggaagctaacaaaaggctggcatcccggttgttaaaatacagatgggtctttttgccagaagatgtacaagtaagcacgttagaaaaaccggtgtagttgccatccagctttgaaatgcatatttttctaataaagtcaaaaagctcattttcttgcacaaaaggctgggcagcataatcttcaactggcatccactgaatgaaaaaaacgagacaccagttaaataattacagaaattacaaagtttcctggtaccaatgtcttgatagattatcagcatgtagccttcattgacttggagagatttaaaatgaagtatgaacttaagcaacattttagggtgcgtttggtttgttatttattttcattttaggagtaattaataattaacagagtgaaaggtgaaaataatatggtatttctttagttatacttaaagacatgtcaactgaaaattagtgagattctcaattgacattagaatatataccttcgctgcctcaatttctgaagcctgattctgaatgtcaaacgattgaggttgcaacatgcaaacaaagaacaaatctgatttctcgaagaacgacttatggctttgcctagtacaaaagaaataaaggtcggtgaacgtgaaggccacattcaatattaattcagatttcagagagaaaaatagtgtaaattatatgcatagcagtatgttggttatttgtggaaaaaaacgcattcacaccacatattacctgaatgctaaaacttcaacaaactttgtttctatctgaaaaaagaatgaaagtaatggcattagactttgaaacaatccaaaaaacatgtaatatataagctatagataaaattacaaccaagtttgtcaaaacagcaaacccaaaacttggtcgatattagttgaataatttgaattaaaatttactaagtaatattatttaattttaaatatttatattgtcacatgcataaaaatatagtgtaattatgaaatttcaagatttcagaggagtttaaggtttgtaaggaataaattctgagaaaaattaagaaaatccatttttttttttttgacaaaacagagaagcataggcctttatttttggggtcaaattggaatcagtctttgattataagcaaaagagcaagggaacataataaaaaaaaggaagggtcttaatcgtatattagatatttactaaagcatgataattgataaaatattaaatacacatgaatgccagtttttatgatattcattaaattattttatttttacatttaaaaattaagtttgtaaggaaaataataaaattttaaaaaatgttgtatataaatcttactgatattgttttttttttcttaaaaaaatacataacagtgttagctaaataattagtgacagagaaaaatataaagtggattgtaaattatagttgagttcggggtttgctattattttgacaaatttcaagtggaatgtaatttactctaaactataaattatgtgtttgcttgcttacccccgtctcttctttgacttctctaattgcagcttcacagagatcttcaccctgcaagtggatttgaaacatatcaaaagataattttagaagtttaataatttggtcggtaataattttgacatactttctgtccaaaaataataataataattttgacatacttcattaacagctcctgttggcatcttccatacacctgtgcctctgaatttgccacctgtttcctgaaccacaagcacctgtcaaatgaaacaagatcatttcaaaggtttcctcctttattcaggcttcaaagcttggacttcaaattgaaaaagaaataaagaaaagattacctctttgttattgttgatgacaaaagcaccaacaccgacacgatgtgaagcatttgcaggaatggtatgaggagtatctggaatccaacggaccagcatcaagtaatctggctcagcatggtggtacctaaatccagcctgaaaaaggagcacaaaatttgtagcaaaatggcttcttaattaagagttaggcttaggcaaataaatgataataaaatgtatgtttaccttgactgcaggatcaacaagatttgaatgttgtatgggcaacttgatccagacccccttcttgccctgttggctccacttgtagattgaagcttgcaatatagaagagaagagcgtagaatccatagggtcttggacgtctacaacgactcctccatgatgatcctcaactccactgagcaattcaatcttttcaccttccatttggttgtgtagctcttctcttgtaatatatatatatatatatatatttgcagacaatgaggggatgagatgagatgataggaacaaacaacgtatatataattaattttggagaatggatggaaggaaggaaggtatgtaaactgaaaatcaaaggtagtgatgaggaaatttcattttggtggttttcttttcttgaccctttactttcccattcaacatttctaatacggagacaggtgaatcaccgtcccatttttccatgagcacggcggtgtcattgacctgttgcggctcaaagtacagccaagccgtcgaggaagtcatcaattattcaattacttccataattgtttttttctacggactctaaattaaataataataaagatttaagaatgaccttttcttctacaatgtttttctcctttaattcttcttaatttctctgttcttgtgtgcttgtttttctaaaagttaaattactttctaagttcctaaattatttagcaatttaaaattaagttcttgaattattttcttaattaggagatgaaaaattaataatatgaacttaattaaaaaaagtcaaaaatctagtttagttaattaagtagaatgtataagttattataaaccttttaatatgtattcaattctcacatattaaaactcaaagatgttttgttttttttttttatatatagatcttcaaatatacttagctgataatatttggaagcataatttaatcaattctaaaaatcttttaagagaaaatatataaacatataatattaaaatgaattatgtatttaaatttgaggggttttacaataaaggatttccctatagttaaccattaaattaaaaagaagtaaattacattaattatttttgagattttatgaaattatacaattttttatatgtttttaacatttataataatctcaattttcttatgtataggaacaagatgtaatattttttaaataattaaaagaatctaagtaacgtataaggggacgtcaacgtaaacttttaaaaataattaaggggttagtataaggattaaaaaataagaggatctgtgtaactttacaaaatcttaggcgtgttgcgtgtaatgtaatttattcattgaagaatcaaaggttaaacttgtgatattataaataagtgtatttgtgaagttatgaaaatactaacagttcattttaatataattagtagatgctatagataattatgaaaaacccttatataatagaaagagaaaaaaaatactaacaagtattttaatagtaattaaggagttaaagttagaaaaaattacaaaaaaatacattatttaatgttagcagcaatttattttcataataattttcaaaacaatgtctttctgtttattagtttcaattgaatacttggtagcaagactttaaaaaagttaaaagcgattagacaaaaaattcaattaaaaataaatataattttaaggatccaattgaaaaaaaaaaattagaacctaattaaaaattgttaaatagttaaagagcctatagaataattgaacgtaattaaaattcatacggcctattaaacaaagtgagttattctctatttaatttaatgaatcttaaacctcaatttaattaaaaattacttaacttataactaataataaagttaaaagtaatatataaaaatgtaatgctggattcctcttgataaaacttagtttttgtatccaatagaataatattttgctattaaacaaaaattgtaaattgtaaacttacgtgtttttgtgttgctcgtgctgctttgcagtatttcaaacagcccaaatggcatgtttgtaacatcaatagctaaactaaggttaaatgaacaagaaaacttgaaaagtaaacagcattgaaaattgacatcaacataaaagcatgatctctgaaacgctaattattttagccagaaatccatcattatcatcttttccagctttttatagtatattattctattttcgtttaaagttgtaccttgatggcagcgcctagagcatccaacaaatttccatctgaactaacaacaagcccatcaatgtaaggatcccaacaaatttttccttcaacgagaataagcgaggagaggtcaattccagcacctgaggggaaaaaaacaagagctcaacagctatattaaaaagaggcaacaacatggaagggaaagcatatggtagtaagcataatcttcactctaggagaaaatagacctgctccacttttaaaactatttaaagcaaaaagtaaaaaaaataatgtctgccagggtttaataatcagaataccctgccaaatgtcaactgattaaagcctagcccggggaataacttcagtttcaacagagattagttgatatgtcaatctctttctaccatcacaacgaagatcttgaggaatgaaatgtttttctcaaagagataaacccaccattcctgcaaaagtaagatttttttctctgagaaatttcataactaaaaagtacaaagcggaacagtcaagtaaagtgttgttaaaccaggatagcagtgtaccaccctgttacagtctaagtagtaagtatatactttctgattatccatgttatgcttgcaggagggtcttagtaataaagttaaatcctttctcaattgaaaattcttattacttatgtacaccttagtagcatgcatcccttcatttggaaccatatactctaataaagtgatttcccaacctgcctatgagttaccacacaacagaaagtcattaacttgaaaataaggaaaccaatcctaactcaggtatctcaaatgcttgtcatcattatctatttcttccactgatttctcgaacacagtcactttctatatacaggagattaaaaaaataaacttaaagtcaagtgttctagcagctactttttacacaaagaattaggattattagacaaaacacaaataattggtctcagaacttaaattaaaaaggcaggccccatatctggagcactagcatgccatatcacaagcactcataatagagaagagagaatttacaattacaggacctgatttttcttctaaacttcaatttgaaatcaaaatacctgaaaccaatcatgataatatttacaaagcatttgaagacctaaatggcattcctaagtctaaacacaataaggagttggcgaaactacatcagataaaaaaggaacaaagagaaaactcctagaaaagaataattactaataacagcaagcattcacaatcacaggcgtataaagaaaggcataaaaataaaagaaccatttagctagcatattaatggcatagatagaagatggaaatctgaaattgttatgaacctgaattggtgaaattagaaagtgaatgatagttagattactagtttcataaaattggattatgagtttgactagaaaatattcttagaatttgaacggaatgaatttactctttccagtgactttgaattttgaagcacacaatgcatgagaggagaggtttgaagctgataatgggctccacaaacctaaagacatagcagcgtgtttcaggtttcggagtctgacagggaaatccaaaaaaaaaaaaaaaaatactcgttctgtcaaaaatactcgtttattaaaaatcatctattttaattttagtgggttacacttatcattgattctttctcatagattctttcttttgatttagacatgagatctaccaaaattaataattttaaaaaatattagtcgatcacaaagagtatgtcatagataatatttttaactttcttcttttaattttgttgtggtgttgtttgaaattgaatgaatggaaattgttctctattaatttagctatcaatttccgcggttgagcttgagccttcggtgatgttagttaaagttagctttaaatgattatatgaatataaattattagaaattgagtgagggatatggtgagtgtaatctgcaagggaaaattttctttttttccccagttgctgaaagtaaggaccgaggtagtaggagatatttgcttcgtaatgttctgttggaatgcatcaatacgtgagtgactacattgcttggtaaatggtaattgagaaatcgtgatgccgatagtgcattggatttggagtggaagctttgaataaggaatgcgttcgtggggccatgtctttgaaataaattgctgataatatagatttcttatttataagatataattctaaaaggaaaaaaaatcaaggtaaacatatttttatcatacacgttttaagtattgatttttagacttttataagtattttatttatttatttaagtgatattgaaagcttaaaagaaattgtatctatcattgttgaaaatgactttttttttttttaaaaagtaatgcttgtgttctataatatataaatatatttatgttctgttgtataaatatatttatacaaaaatacttttacatttatgataataatttaacaaaatatacaaactttcatgttgttgatataaaaaagaagaaagtggaaagaaaaagatttcacaaaaatgaagctttgtaccgtgggaaaataataaataattattctaggagtgagacacataaaagattcatatgatatcattttaatatttaaaagactaatttgatagtaattttgaatttgaaaagaataatagcgtggcatagttaggttaacagttagaagaataaattgaaggtttgtcatttatgacatttgtggcttagacataaattgaaggcaattagtgattaatggcaaacggtgaaaaactacaagagatagaagagccttacacgcaccgtgttgtggcctctttccgttttttgtcgttaacaccgaaactgaagcaaaagtcagttacttgcactgtttcatttaaaacttacaagcaacaacatccttgtacctctttcattcttactatgcctttggccgcgtatgtataatataacaacattttttccttctggttgttggtactaggcaaatgataaaaaaatctcagtgtaagtatgctagtaattggaaaggtttgctgaatctgtattcgctcaagtaaagaggcaacaggtacaataattttgattccatgctaaatctgttcaattttcatgcaagttgctcaactaattaatttgttcaagaccaaatgaatattcgttgttgtaaattactatattgagtttatacaatattgttgttgtctctcgtgtttaatacgactactaattgcttctggtcatttcatattcattcaatgaaatagctgatatcaaacactaagtatggttggcagtatcttttgtttgattttactttttttatgcctgatataatatgtgacaagttctctgtaatagaatccatcatttttttgcttgattggttaatttgtcatgatgcatattccccattagcaacatttttctttcttcgaaaccgtcaaaatcatgcttcaccaagttcaactgtagtatatgatgaggctaccatcttgctgctggttccattttaggtatcagagttttggatgacccgctttctttttcttctccctctgttttctttttaaacactttataatctaattggtttcaccttaacataatgtgctgaatctgcatgtgggctaattccaaacatctcgtacttcaagttctattccttctgtgcaaaaacaaaattggtggggggaattgtatttttttaattaaaactacctttgtcgactagtcacgaggtaaaatcaagtcaaaataaaaaaaatatacgcgttttagatgagcactataattcaagcttctgaaatttctaactgtagcacaagtaatttaggagatataaggttaatctagtggttggggaaggatgaagggagaagagagggaggagagatcgcgggtataaatctctcaattaacatttctaacaaaactaacaaattaacattcgccgataaaaaaatatcaagtacacaaatatctgatcttgttggtgttcggcatgtgctatctctttttcttaccgtttatccttgtgtttctttttaaggtgacttcatctcatcttagacaacagaaacaatggcaatgcagggttgttattgtcactatacgaagttggcaactcaaagaagaacactggacaatctcagtttttcaggctcaatttcggttaacaaattgtcaaagaatgaaaggaccagaacatgtgatccattatcatcagggaacaatcaattttataggttaccggtgaaaatgcgacagacagaaatgcctgcctcaaagtatggaacaaatggtaaagctgttagaatggtagggacaaatgagttagtgaaaagaaagagaatgttagagaataaggtggtgaatggttcagcaacttcaaaggaagtgagaaaaaatggtatcccaggcttgaccaagacagtgaaatctagaaggtcattggaagagctaaaggttttagccacagatgaaggtttcagttgggccaatgaaaattacagttcctggcagaggtctattgatgtttggtcttttgtggcttctttacgtattcggattctgttggacaatgcaaaatggacatatttcggaggtttcacagaggcaaagcaggtaggttctcaaggttcggttcttttcttgctaaatttaaaatactagtattttccatttatttaaattggccatgtttctttttgctgacctgaatttttttaatatttttatttagaaaagcagaaggcggaaaactgcctcatggttaaggaagtgtatattgcagcttggtccaactttcattaaacttggtcagttatcatcaacaaggtcagatctatttccacgtcaatttgtggatgagctcgcaaaattgcaggtatctctgtagattttgtttttctcattttcagactcatcattgtagatttgtagagattcccccttttttttgttttttttttttttaaagaagacgaagaaaggtgcttaattttgtcatctattctacttatctcattcaaaaaaaattctcttagactatcctttattaaaattcgatataagaaattattgaaaataaaattttaattaaataaaacttattctgaaaataacttcgttaaataaaatgaattaagatttgcttgtatttttaatcaatatacatgagggtttttttccctatattcaagaccagaaagtaattcttatttcttaatataacattatacaggacatggttcctgccttctctcctaagaaagcaagaaaattcatcgagagtgaattgggagctcccattaacatattatttgaggagtttgaagatcggccaattgctgctgctagtctcggtcaggtgtttgaatctagcccagctcattccattatatttattattttggttaaattaaaaaggataaagtatctttctgtttattacattttcataaaattattaatattaatttgattcctgtaaaaataaatgacatattttattagttctcaatgataattccattagatatgatgtaggtaacaaacttacacatgtaatttgattataaataaattaaataatttgtaatcattaaattccaaaataaattaaacaaattatggcaactaaacatcccaaaaaattataatttttgtcatttcttaaacaattttctcatactatccaatgagattagggaaaagatgaaataacaccaaattctggtatttttaagtgtgtttgaaaagatagagagagaaaaaataatgaattaggcatatagaaaattgtctaaggggttaggggtctaataaagttaccacggaagacaaataaatatatgttttattttttcacgggccaaattaattcaaaaaaaattatgagaaaaaaattaatacttatcaaattttacatgatccaaagatattttacctaattaaaaatttggtcttatacttggatactttccattttcatccttaccttaaaaaaactcacattttaacccctgcgtgcaagcgtttaccaattacttcacagacattattatgcatgggtcaaaatgtaaactgactttatgtagggagaaaaaaggatcaatataatttgaccttatattttcttacattgaatcttttcctattgttaaaaacttgtagctttattcgaattggtcaaatttgataaatgtaacatgaagtgagaggcagcatgtggcttagtccattattagaacaaactagaacgtttctcccatcttgtagaccatgataatagcttattaatgttgttcttagtatagtaacatcaattttggaggagcctgtctgtaggttcatcgtgctattctgcataatggggaaaaagtagtcatcaaagttcaaaggcctggtctgaagaagcttttcgacattgatttgagtaagttgtggttactttgtttgttccattgacaaaacctagggattttgattaagaggatgttgccaacagccaattatcaatgaatccaaaagcctagactgttaggtacaaatttgccctttggtaccaaaacttatttatgtataacagcatagagtttaaggattactattttagtgaattcttttgtttagggtttaaggattactattttattgtttgtttgtaactattacaagtttgcttgtttgttatgtccagaaaacttaaagttgattgcagagtattttcagagaagtgaagcttttggtggtccacttagagattggattggaatatatgaagaatgtaaaacgtaagtaataagcattgaagtgcattgttatcgatatttcatgaagtaaagcatatgctaaattatgctcattgctttttcaccttttcttcattactttattttccaatgccttaatttttattgtgttgctcatgctattttgcagtattttgtatcaagaaattgattatataaatgaaggaaaaaatgctgacaggttccgccgagattttagaaacataaagtgggttcggatacctgtatgtttccttaggcaacacaaacatccgattataaattgtataaatttttaatgtctagtaaaaatattgaattttgaccacatcttcatttctttcgttgtagctggtatattgggattatactgctttaaaggtgttgaccatggagtatgtaccaggttttcatcttaactaatgaatgtgccttgtttctccttttaattatctatgacactatggtattatgagagataatatattgtatttatgggagctaataattctttctttaaagttatatattttatatgacattatgctagagaacgtatttttttaactgctcctatctctgattttattccttggacaggcatcaaaatagaccaggtggatacattaacttcgcgtggttatgatcgattgcgtatctcatcacgtgctactgaggcatacctaattcaggtggaccaccttggttctctgctaattacgatctaacagtaatatctgatgttgaatatggttttcattttggttactcagaataagtaaaatgtctcaacctatattaaaaccaaaaacgaagaggaatgaattgtcacttgaagataggtgttggtatcactcttgtagccaaaaaggttgagttaataaattatcattactttttgtcttacagatattgaaaacgggtttcttccatgccgatcctcatcctggaaatcttgctattgatgtggacgaagcaattatttattatgactttggcatgatgggagagatcaaatcttttacccgggagagactgcttgaacttttctatgctatgtatgaaaaggatgccaaaaaggtctggatttgtactacttttggattatttaaattcataacattgtcttttactaataagaaatcaatatctgatatcatgatacgctattttgttaagtgtttaatcaacatacattttttaatttcatgataactttttagtttgccacaattaactcaaacaagcacgatgacataaaatggcttttgcttcaagtacgattactattgtaaatttcaatccagctaaccagttattatcgtcagcaaaaaagaatttgacgttgctcataacttgaattgatcaacttcagtgtccctctttcacactattttaaacatacaaccatacaataaacaacggtgcaggttatacaacgccttatagagctcggagccctccaacctactggggacttgtcatcagtaagaatgtcaactacttgcttttcaaatattttgatttgtgtcttgacacttgattgacctcataaatgataaatttattttccaggtgaggagatctgtgcagtttttcctggaccatttgctaagccaggcaccagatcaggagcagaccctttctgcaattggggaggtttgttaacattgttacattggatcaatgaattcatagctgcttttcaattttttcataatattttgggtgtttgtttcaatggaactaaaggataagctgaaggtggagaattattgttttctattggttattccaaactatctggagaatctagtccagactttattattgactattgagggctttctgtggcaggatttatttgcaatagcacaagaccaaccattccgttttccatccacctttgcctttgttctcagggcgttttcaacacttgaaggtttgcatcttctcaattctcttactgtccctctctatctttctctctttagtggtcattcttgcaaaaaaaaaaaaaaaaaattaaacatgccctaatgtttactattaatttcacattagtatatgcattataagatggtaaccaccccttcctttcttgggaaaaatttaactgatttaagacacagttaggtaaacaaccaaattaactactcatccgataaattcttatgaacttatttataagcttaaatgtgaagttgatcaaaatatgtatcactttgaaatttattgaaataagttaaaaagagcaaaaggatatatatgttagttctttgtatgacttcatcatctatttgtatttctttttttctgacaggcataggttacacactcaatccaaatttctcctttgctaagattgctgcaccctactcacaggttcaaagttcagattgtccatgaacaaatattgttcccatactgcattaaaatgcatgctcatacacatacactttaccacgttacaggagcttttagagataaagcaaaagcagcgcactgcaccccagcttgtggaggagataagaaagcaagcagatgatgtaccacaccttttacctttgttctggataatgtttccttaaattagaaaaatctcatttgatgtgaagcatttatctatagcatgtgcaactaatgtgcatccacttgaattgatatttgataacgcttgctcgtgtaatacctttaggctacaacctataccatgtcaatgccatacagagttcaaagaatagaagagtttacaaagcaacttgaggcaggggatctaaaacttcgggtccgagtgcttgaggtcagtttttttttttttttttctttctttattcttatagttgaccccattttttattttaattcttaacaaaaaaattgtaaattttagtctctctacaattttttgtagtagtttattatcgccaaaaagtttctataacagttgtatatcgtcccaaaaacttctctagactctagtgttttcaatagaaatttaactttttatgattaaaacttacaatttgtttcgtataaggactataactcaaaatgaagttcattataaagaccaagtgaatagttgaatctttatttttcttcacatggtgtatgctatgcctatgtgtgaccaagtatttctaagcattttcctaatgggaacaactttctaattaggaggtcgttattctggaacttttgttttgtaaatttgaaattatttaacttgatttgctagtctgaaagagctgctcggaaagcaacggctttacaaatggcaactatgtataccgtattaggaggaactctgctaaatcttggtatcattatgagcagccaaggcaacataactattgcgaatggatctttcattggtgcaggtgactatatattataaagctttttctcaagttattgtccaatcatgttccaatttattcttaaggctgatagatatagcatttcaatgtgcaggtatttttatgactctatttgtcagatccatgcaaagggtaaaaatgcttgataagtttgagaaaatgatataaatggttaccaacaaattcgattctttcaaacttacgtaaagttatcctcatcttcattttattacttgtaatttgtaaatgttcaattttttaaattacacaggcatagcaaattccacgaattttacagaaacatgattgaatgatgacactacaaggcattttatgacttcaagacaaagaaaaaatcatagttttctaagtgagaaagcaaactgttggcccgtgagcctttccttattcaatggctaattttagacagagaacaccccgtgattaagatcatagagtggtaaagcttgtcttggaccgtaatatatctacgactaaacgaactctatctctcgtagcttgcaattaaataggttaaccccattggcggagccagtaaaaaaatttagctcatgccaaattttaagtagtgtcaaattttatttttaaccctaaataattatataagtatatataattattaaaaaaaaattcttcaccactcaattattacaaattttattttttaggtaatgtcgtgatcatggttgatttgcatgcggctccaccactggttaaccctcagaccaagaataaaaaattaagtattaaataaaaccaaaaataacctaaacgtgcatccaccaaaaaaaaaactaaacatgttaaatatatcatttttattttcattaactaatcatgaatcaatgggtttattagttaattattaatgactgatgtatgatgtgtcaattacttatttgacctaatcaactcttcttcctatttgcttcttgatttctcattaagacagtgacatgtggttgcaagataatattaaatggccgatgaatcattatttattgacttaagcaactcctattcatgtttgtttcattatttctcgttaagaaactgatatgtggatgcaaaaataacattaattgactgatgtatcaattatttattgacttaagcaacttctattactgtttgcttctttatttctcattatgaaagttacacgtagtcgcaaaataacattcttttttccatttgttaaaatttatcactgaacttttgttattttccattaaaatattatttttatataaaagaccacaaatattatttatgaaagacaattttaaaatttactttaagatatatttaaattttatgtaagtaaacgagagtataaacaattggtttcataattgtcttcagaactgcaagtggattttgagtattaattcatactctaagttaatataaggctaaattaaaagtaattaaaatctagtatttcagattttatatttgctgaatgatctttacattatcaatagatatttttgaagaataaaacatatcccgtcttaaagtctgattcgcctttatctgtaataatttaagaataaataatatatatatcaaagatttttatattattatttaattataaactgttatgtatgatgaatttattattttttataataattatcgaaataattatataaaaatatttttactagttgagaatataaaaactttacgctcattaacaataattaaacttataatttaatttttgtacaggctcatttgtaaaggtggttaggaaggtgagggaaataacgtgcattggctgtgggtcctgagccgttggttcgtaggctcgaggattcaatatggtaggtacacttttaatggtagttattttttttgttttttctttagttattaaatgcagtagtactatttaaatcatgttgtatatgaaataaatgttgaaagaaaatatttaatttatgtgcactcacaatttttaagaatatttatctcttatttttagggtgaatattttgtattaatgtatcatggtcagaaaaaaaaatccttaaataacttttgattttataaaattgggtgctttaacaatattatgctattttggacaagaacgatcaaaaccaaaatgggtttaaaatcataactataagaatcaaaataaaatattttaaactataaaaattaaaaggtagaattgttgcaactataaggaccaaaaatatatatattataatttggaaaagttggaaattttcaagctttcatgacttagatattttcaataaaaaaaaacaaggttttcgtgatataaagtatattcaacatggttattaaaaaatattttcttgagaaaagtatttaattttaataagataataattaaattattttatagaaattaaatttaagaataattaattttttgtagttttttaattcttatgtaaaattgaattttagtattaatagttctatctaaataatttatatggataatatgtaaataattatgtaatttatcacccaaaattgaaaaagacaataatatctgtttatcgcttaataatataattctagtattagctcatttgtaaaggtgggtgtggccgtgtgggtcagtgaagcaacgtgcaatggctgtgggtcctgagacgttggttcctaggcttgtggatccaatacggtaccgtttaataataggaaaatatatatttttagtcgtcatattttcaatcaaaggtattaaaggttcatatattttatattgattaatttaattctcagttttaaaaatatataaatttagttgccactatctaaaacttcgccatattttttaataattaaaagactaaacttacatttttttaaaaaatttaaagataaaattgatgaatatcaaaatatagaccttgaccacatttaacgaaaagtatagaagttaaaaatattttttttctaataataatttcagttcactttatattttttattaaattaaaaatatatataaatttttgtgagtttcactatttatttattgagtttatttttaatttgcagttttaaataaagtttaatcaatatgacatttgtttccttttaattattaattttttagaaaaaaaatttactatctggtatttatttttcacttttaaatttcaagataacattgattattagtttgtcaactattccctcacttcttacctaatttatacattttatatgtatttattgtgaagcaaacctaaaaaatggtataacaggaaaattcaaaaatattaaagtaaagacaatcttaaaaagtttacaaactaagggacaacaaaaattaagatattaatatcagtttaacactttttgtgtaaaactaaagatatgatccacaataaaaatgaaattgagaaaatatcaattcaacaccttatttttttattcatttttccttaataatattgtttttcatttttctctcttatatttaaagggtcttaaaggagatgggtcagtgtccatgctgattcctcttgggttcattcctaacttgaacaatagtggcatctcttatagcgtatttggtaggaaggaaataaatagatgagagataaaaatgatgaaattagggaaaagagaaatagagtaaattgaaatatataagaaataaaatgaaatgtgagtgtcttatttaagagaaataaaataaataaatacaaaaaatccattttagtattttcaatccattattttcatgacaattgattgtcatacattttaggtagtttaatgttggtttcatatgaattttacacttttttttttattttctctctaatttccatcctattaaacaactcacatttctcatttattctttattatccttcccttttttctattttccttctatttcatagctaccaaacaaattggtaagccaagactttgttcttgctagaacatcaactaattatttaaaaataagctataagctaagagtttataaattaattgatttatttggtctaagtaacttgtataaactaataagaaaagcctataattttccccaaaaccttatcaaacacactaaaaagaacaatgcgggtaggtaaattgctttacatcgtgtatttcaggtctctttcatagctatgcttgataagcaattgatttgggtaatggttatttgttacttgacggatcattttgaattacctcgttaatactgtctataaacaaattatacaggggttatgattatagatgtcaaataagtcatctacctcttatgctcgatcaagctaacactatccaccgatacaaatcaaacaccgaaagttaaatttcaaaacttccaacgaatcttatgtgacttaattttttattcattccaattacaattttgttattttaggtattgtattcattcaattctctccgtcaaattctattagaggacctggttggtcttgatctttattttgtaattatgtagttgagattatgggactgtttatctatctcatccttttgatatatatttaacatcttcatatcataatacttgatgttgaagaattgtgtatcatttaattcttattgagttgacgtgttcaagacaactcggatgtcgaacaatcttattcaaatacgacattaccatataactcatattagatctagaaaacaaacatattacatttaacactttatgctcttaggctaggtttcctttcttcgatacacaatcttccggcagtcatatataattttaacttgacattggtaagccacatgatacttcaatccacgcagacaagaactaattttaggcctacaatttatttatatatatatataaaaagtgattaaattatatcgatataattttgacaattattatacaattctataactttcaactaaataatattttcttaaaactcatatttggttgaaaatttctttcacataaatcatatatacaaaatttcatattaatccaaaaatttattaccttattcatatagattaaagtcaacataatataaacatttcaaaatatactaaaaaatgaataatttgattatcttcttcttgttattcaatttcgacaaaatttgacataaataatctcaatactatatagatataatttaacgtttgaataaataaaaatcacattttatattaaattataaaaatagtataataattgttaaagttacatcaatataatttgatatctcatttctatatatatatatatatatattaaaagcgggctacagtttatatgtatgcactttgtttagttgattggtaggtggctcaaggactgcaagtgtgtctttatatgaaaaataaaaaacaattagtgtgcatcgcatgcaccccattccaaatttaattaagttatcatctctgttcaactaccccacaccaaaccactttgccgttgctccccacagtgctctgtaccaaaaacgtgaccaattcaccaatcactgttgtatgtaaaattaccttaaacttattatcaatttatttttaagaagacactattgtaatcgacttttttcatgtgcatgaagatattttttaaccggaaatttaaaaatatttattttataaaaaaatcaaaatgaattatatctatcttggcaaagcttttctacacaccctaatcagcatgctatctaacaatttgttggtttttttggtaacatcataacgtaatcgatccacgttaaatttacacagtcgcctaagccaaaaaatgtataaaagagaagaagaaaggaaaagaaacaaattgaagtaaataactatgaaaaattagtgaaaagggtttttatattgtttatctaatcataaattatcatatataataaattaattaacttttatgataattattttgaaagtcattgttttttttactgatgatagtaatgcaattttatacattagtaataaatgcatgcataaaaattataatttaatttatatatatttagagtttaaatttttttacacaatcaataaaaaaaacatgatattatggtaaataaaataattatagaagtcaataaatttcttatacatattgatttattattagataataacattataaaaattagggatatttgcatccaatctaataaaaaaaagcttgcaaactgatctaaaaagaagaaaaaatttgataaaaaaaatatattttaaacctatgattaggttcgatttaaattagtatcttaaaaagatttaatccaatccaataaaatatgatttgaattagattggatggttcaaatcttactactacatatattattatttttaaaacaaacataaaatgtatgtcaatcaattgattaatcatcttacaacataacggtgaaacactaaaaaaatcatattaaaatatataaaaatcatatatggaacatataataagatatgtatattaaagagtatcgtttttgcttagatcgatttagttttgctaacatcaattataaaccaatccaaatcatcgattaagaaaaaacatgatccaactcaatttgcagaagatgacttttatgtcaaaagtgaatctaaatcgatttaatcattcagcatcgagcagaaaaaaaaaaaaaaagttgggaaaataagagtaattgtaactcgtggctcctcccacctgagctgaccatatataagcactcatatcagtcggacacttgttcacttcttctctctctcgtaagcttctttgctcaacactttatcagatccgcgtttcgcttagcaccacatcaatatcatatttgcttctctcttcctcacttttctattcaccgctccttccatcttatttgcttctttatggatacattaagacaccattccaaattttattattttcttacaatctcgcgctgcttcttttctttttaaatttctgaatcatttcatatcaagaggtcaatttctgatgtttcacataatccatcgtacatggaattagttctcaatgattttgcatgttagctcgttaattttacctaaatgtgtccgtatttaatgttttggattacagattccattttcatctatcaatggctccagtagctgcagcatcttcagattcaatcaagccaagaggtctttcatcaaacattttggcttatagatatagagtgtttataaaccctttctttggttcatttaacaccttctaaagttttattctgtataaccctttatttggttagttgacttcatatgttttgatttctatagatgtttgcatcgttggtgttgcacgtacaccaatgggtggatttcttggtactctgtcatctctatctgccaccaagctaggctcgatagctattgaaggtaactatggaagcctatgtcagtgcttattacattccatttgaaacttatttgtgtttacatatttttcattcatctgtagctgctcttaaaagggccaatgttgatccatcccttgtggaagaagtattttttggaaatgttcttagtgctaatttggggcaagctcctgcaagacaagctgctcttggagcaggaatatccaattcagttatctgcactaccgttaacaaagtttgtgcatcaggaatgaaaggtgtgtttataataaaaacaattctatttgtttctttgtatttttgtttaaaaatacagaaaaaggatattaaccttgttccggttattgcagctgcaatgcttgctgcacagagtattcaattaggcacaaatgatgttgttgtggctggtggtatggaaagcatgtctaatgtacccaagtacctggctgaagcaaggtcaatattgcctttaattcgacactctccttaagattagttcttgtgttgaaataaactgattcaatactaaaagttcaggaaaggatcacgccttggacatgattcacttgttgatgggatgttgaaagatggtttgtgggatgtctataaggatgttggcatgggagtgtgtgctgagctttgtgcagataaccatgcattaacaagagacgaccaggtattttaggattaatttctgttcagaaaggtttcggtaggaccattgtaatcaattttttgttgatgtctctgttttaccctcaggataactatgcaattcagagttttgaacgtggaattgctgcccaagaaagtggtgccttttcatgggaaattgctccagttgaagtctctggcggaaggggaagaccatcaacagttgttgataaggatgaaggcctaggaaaggtacccatataaataacttgaaccatggtaatacttgttcttgtataaatatggtgagcctacgaaaacacatgtttacccaataattcacgagactttaaatttgttagaagactataaggtgataattaatcaagagttgggattggaatttatgatttttttctcttcacattaacaacatttatatgtatgttacttctagctgcaattattgttactatagtcattaattttgtctatactttcagttgaatacaaataaatatattgttaaatttttccttttcctatgccagtttgatgctgccaagttacgcaaacttcggccaagtttcaaggagaccggaggctctgttacggctggcaatgcttccagcataaggttaatatgttatcgaaatttgttaaaatttttcctacataatgatttgtatttggatgcccttgtcaattatttattgttataaaatactatatatatatatatatatatatatatatatatagggagtcaaatgacttttttaattggtcgtgtgaccttaaaaaacttttaatattgacccttcgtgtatggttgtatggtccaaatttgttcatcttattcttatatgaaatggaattttcaatatatacatctccaatatgtgtgtcttaaacgctcaaatgctattaatatttttgtaatttttagtttgacattagtgattagccctggtttttaataaaatgaaaattctcttgctaacagtgatggtgctgctgcactagttttggtgagtggagagaaggcactgaagcttgggcttcaagttattgcaaaaatcactggatatgctgatgctgctcaggtatgtaaaatatattttaaatatgaactacatcttcagactataaaaaataagaaatagaaaaaccattttggcattcacattatttctagtgtttgatatgttataatttcatactcatatgaggttgagctgtgcaggaaccagagttatttacaacggctccatcccttgccattcccaaagctattgccaaggcggggttggagacttcacaaattgatttttatgaaattaatgaagcctttgcggtaggatttcatgtcaaggtttcaatggtagtaatttttcaactcatgatgcggtgaattttaattcttcatattgctgtctgtaggttgtggctcttgcaaatcagaaacttcttggacttaactcggttagtttttccccttgtcactgtgcgaaagttgtaatccattagtgcatgtataataaactatttccaattgactgtcttgaagagtgcatgctgttgtaagtccagaacccctctttgcacagtgcagaacatgttaaaatttgtctataatccataatttaacttcattatgaccattaatggatgcacccctccatttatttcttttactcaagtaactattattttgcaggaaaaagtaaacgtacatggtggagctgttgcactgggtcatcctcttggttgcagtggtgctcgcattctggtgacacttttgggggtatgtgctcagttcataactttgattttttataatatatagtagcatgcatgttgacagattgccttgtgtttgtagaaaaaagtctatcataatgctcatctcttaaattctttgtttaattatttaaattcgttatgttcaactattcaaaaagataaagataatgtaataattttattattttgtccacttttttttaataaattacattgagagtagtttgttgtgagagtgaaatgaacaaatcttgatcatttgatcttatatgaatggtattacaacacaaaataataagatttttaaagtgatcatctgatattttaagtaacttataattctgactataagttgttgttgggataaggctttgttgttgttgtttatgattttgactaactatgtatggatctttccccaatattgaatgtgttctttttcgattcagttaatctaaaagtcatcacctgcaggtactgaagcagaagaatgggaagtacggagttggtggcatttgcaatggaggaggtggtgcatctgcccttgttgttgagcttctgtaagacctatttcatgttccgtagatgtacttttaagagccagcgtttgctgcaaagctcaaaagatcttgcctccctctttagcaagcgaacatgcaagtttcaaatttattacaaggacaagaccgaacgagagagaaatttagctacatagttgttaggtttaagtcgcatcttgtgaaagtgaaattttcttagcatcaaagtagaacatgaaacaatattatccaaattttagttttcaccgaaattttattggggtactttggtttggaatgaatcattataaaacctgttattccaagcacaagattacagattcccgtggtttgcaaaatgtgttccagaactgaaattgccaaaaaagtggaaataatgaagttgtagttggtcttgcgtctgctaatttagatctaacattttattctgaatattctcgcacgccaagcacgtcaaagtattttctctttcttagggggttggttaaaaagattcacaacacgcagtaggattgactaagcattccaagatattttttttgttcctaagattaatatgagaaatttacagtgcaccgtctacattaagtttttgggttattattgttattgaagtaaaatatttatcaatgataaatatctattaaaaaatttgactaattatttctattagagtttttttaattatatttttttcatatataaaatttaaatttgagatcaagtttaattttattcgaattaataagatcttgataattaatgctagctttagatagaatctattctacttattcttattgcctttatttttcttccagttacttatataaaagagtaatgttagcgcatactttctactccatttggtaaaagatttttagtttggaagattagtggtcaagtgaacgacgaatatttcttgaacttttgataactaacatgaaggaggaataaaagatggttatccaaccaaatacgtaaacatataaaatcgtaaaattaaaactataataatataaaaagaatcataaatggtaaacttaatatatacctgcttaatttctgtacttttatcacactagtttttgtgtaaagaatgaatatttaggtgagagattttaaatagaaaatttaatttgtaagagaatttaaaattttaaatattaggccgattgttatagtttcttttatgaaatattttttttccgttttgcatgattttgtttcaatttttcaaaataactggaaactaaaaaaaatatgactaaaatcagaagttagtttgaaaagtttttcataaaatcagttatttcttaaaaaaaatattttttagaatggtaaacaaaagcaaattaccttatactgtttttttaaactattttacatgagaataagttttatttaaaagttgtatttgttttatggtatcgaaaaagattatcgagaaagtgactgagaacatcgtattttcatgtttgatataagttctataaaaaaaaattattgatttatgcaatatgaattatttatacttgtcattttattttcatggtgaaatagaaattatttttttggaaatggaaaggtccatcttacattcccataaaaaatggagctattttctactatgtcctcacttcattctttcacttttatagttttatttttaattttttattgaataaatttttatggaaattatatttgtacgcataatactagctgacctatttatgaaatttcttttatgaaccctagcctagcttgcctcagcttcttacgttttcgcgctctctctctctctctctctctctctctctctctctgttgtgaatcgagattcatcacttaaactcggcccattgtacgtttctctttctcatgttcgtttgctttcgattttattttgcttcctaacctcattcttttccttctttcctcagctccgctttcttcaaatcgtaaagttttttgggattgaagaccgaatcgttagtgagttttagttttaatgtttgtctgttacaacaaaatctttgttctgttctatagttttcaaccatcttgctgctgattttgtgatgttcaccctttctaagctctctcttgcagtgttactacctctgcatgtacttaaaaacttgttaggatttcaagcatttaaggttgaaaagattgtgtctatgagaatggagttgaatgctttccccaagtcaatttcaagtcagttggggattttagcctctattttaggttgtaggatatattggtatactgacctgaactttagtaaatgaccttttttgaaaacctattcagttcacattgtttctattggcctaaatttcacataatgggaaaaatttgggacttcattggtggaatgtcgtgttcaagtgagaagcatgggacatacaaagaaaaagtgctaggtgaaatggtgaatcacccaagcaataaattactgctatgactcatttgcttctcaatcattttgttcgaagtgatatttttggagtttattaagaaattctacatgtttagttgttcgtgttctcttatttggtttaatctattagaaaataatgaaaatctacatggtgatgctcttcatcttatccaaattatgtcaacccttcagcactattccaattctaatagcctatcatcttactgacgttgtcttatagtccaattgtgtcatggtacaacttcaatatcctcaacacatcccatctccctaagcaacaattatttttgtacaaaataatcaagaacctaagataatgagagaagactatgatatatagaaatatcgaatagtataaaaattcatttaaagaatttgatattatacacacacattattgtttactaacctaatacctattaagttacacaaaaacctctcatcaatcttcaatcgtatattttagttctgaatattcataaaatttccgtgatatgaattcatcattttatttttttaggggattttcagggtacaatggcttccaacatctcgcccactgcctttgataaagaacaggtaggcattcttttctcttcctccaactttggtaaaactgatctggtggttgatgtggtgaatttgataccccaatgtgatttcaagtttaaatttgcttttctcggtgttatttgattatttagttgtggatgtgtttcaataattcatgtggtcatggagcagatatttggaatggctgaaaaggagatggaatatagggtcgaattattcaacaagtaggtttccctgctcttgcttgccttgatattgtttgctgttgtaaacaagtatactgtacaatctgactgcatatttttatgagatttgttggtgccataataattcattttgctaaccttctgttgtttctaccattcaggatgacccagacctgtttcaagaagtgtgttgacaataggtagggaaactcttatgattgcataatctgcctgagaaagtgtcatgtttgatgcccttcaaatgtcatccagtccagtcaatttggaaattagtttcttatttctcagagttatctgctgttgcattattttgataatggctcaatgtgaatgttatgataatatctgtttatcactttttcttctcaggtacaaggagtctgagctaaatatgggtgaaaatagttgcattgaccgctgtgtttcaaaatactggcatgtaagatgttgcttaagtttactttggatctatcactggcacttattcgagttgctattagttatccttatttttctctcatcaaactctttattatgctttaagatagtttctcacatagatgttttaggatgaaatcttagttgggttttagtacttggttaaatgtgtgctcccttcgaaaattcctggttagactttaagtggtgtcttgataatttcatgaaagccaaggcaaactaagtatatgtggattacagaagtcctgacttcaatatggtttttgcttttgaaatattgggaaactgcaaatggtgattgtcttattgtctaagcagattttttttatattttttttgctaggtgactaatctagttggtcagctgcttgggtctgggaggcctccaatgtaattcaagtgtattgtattttcttttgcggttagcaacctgggagctatgtctacgatattattagttgttgcttccttggattcctttcttcccaaggaagcgtaaattttaatactttgcagagtctttattttgtggtcaatctgctttgtttagaaagggattgatgagctttttttaggtcttaacccctcagtttatcaggggaaaaagatcctaactaatttggagtttggctgaaagttcaataaaatttgacaaaaaattatttgtcaaggattgatgagcttttgaggtaaccattggtggacaataaaattaattttagataaataaggtcattctttgtttctaatttatgactttttagttctgccgtactttaccatagtgcttttctatcaaatttatttaaactttatcctcttgcaactgcattgttcttttcccccgttcgacgttatgcagttagaaacttaagaattatttcttcctttccgttttcaaacagtatacttacttacaattattcctcgcccactttcttgattatcaccaaatatataccacaaattcaaatcaatatattaatacctcaattgtttttttttaaaaaaaaaaaaaaacttgttgctatggttctgctctgacatcaagtgtcttaagacatgttgaagagtattatattaaaatgtgatagaagttattttttactctgtgtactaaacaaatagcaattacgggagtgacgagaatagagagggtattgcaacataactttcataaaataaatcatcgctcaattttgtaaattaaaacacaagttcgttaatatcgtgttcaaccatacaatcattctctctttcaaatgggatcaaacttcgataaattatgacattcataaaagtatgtattgggattaatacttttagagaaaactcggtttgatttttaaaagttacatatgccatcattgcatttgaatctaaatgcattattttcatagttataaaagattgataaaaataaaaatctaatttacttagatttaattccttctcaaaaaaatagttacagattttatcactgagacatggagacgttccagaaccttttgctacttcctgtctatgaacttctacatttctcagagatagatctaataaatgggggttgacttaggtcacataaattaggagatcaaagtgataattcttaaacttagaaaattaaaatgagatgccaaagttctattttagtctttatataaaatatgttaaagtgttaaacaatagcattacaaatactattttctatgaaaaattattgtagttaattaattaataatagtaaaaacgttgatgagagtggcagtggcagtggcagctaagtcgataccgtgcacatgcaatatgcatgagaaaatggaaaaggaaaatgtaaaaaaacaagaaataaaatagtagattaaaaggaataattccaagctagccagaggcaaaagtgaagtgaggtaataaagacagctaatgtgggtggggacagaaaagtggccgttagaaacttgaacgttaagccgatgacagagaatccaatactgatataaatactcccatttctgagtatctttcattcactcaaaaactagaagatggggatggttgtggtgatttctcttcctttcataatcttctgcttacttcttggttttggatgttacttctttggaagagccagaggaaggagagaggttcaaaccaacccacaagtttatgtgatgccaactccacccccagctgcttcaccttcaccaccccggccccactccaagccagacaatactcataatgtttgatttcaaatacatattgggtttcttttgttgtaattatttggtccttttagtaattcactccaataatattaagacctctcccccattttattcatttccataacctctatttattttttgtcttttatgtactatcccttgttttttggttgaaagttaaatcaacttttatacatttttattgtctgaattcaattttgctcaagttgtgtttatagagccgagcattccatagtgtcactggcctttgcttagtttcacaaaataccatcaatcagtcattagtctttacgatgttgggaattttaaaaccaaacaaattctcggttaagttctttcttttttttacaggaaaaaaaattagatgttatatttacgtattttttatattacttttttataaaaataaagtttactttgttgttattgttattttcttgaaaaatatttagaaaataagaaattaaccttttgttttgtgaacatgtaaaatcaacgttgaaaacatattctccttataattaatagttattaaaaataattattaattatattccctttatttaactttaataaggaacaataaatctaaattaagattttgttaacataaatctttaaaattaatttcaaacaactaagactaaaaagtttaatattgtacttttatatgagaaaatagttttatcataatatttgattgattgttataaaaattaaactctttttttagacaaatttaaataaataattttttttaataaatattttgaaatttgggactgttttgaaattatttcaaatttggagcaatcaaacaagttcaatttggacgtgttccagtctgtcgctaacattttttacggaatattgagattttaattccgttgctatttccgtcactaattcggtctctaacacttctaaaaaatagtggttttttaaaatgtgttgcgactgaatttgcgacggattttaaaaagcctcgaaaagtgttagcgatcgacttagcgacggactgaaaaacgcccaaattgaacatatttgactgccccaaatttctaaatagtttcaaaatagccccaaatttcgaaatatttgttaaaaaagcatttttttaaataatttgcccttttttatatatgtgtgttatacaataaataattttatttatttaatattttgttcacttataataaaatcagcagtaaagaaagcatgaaaaaagagaagtgtatgtctcataaatttgatagtcattgacattggcctgctcctatgtgtttgtctgtgtttctcgatcttcctccttggccttgccctcgagaactaaaaatcaaggaaaaggagaaggatcaattaacaaacatcattacataatataatataaatatatattagaagaatctaacagttaaggagccaaagccacatcattcaattcctcgatctaagatcttgcagctagaagttaggagctagtgatgaaccatggcggtacgtacgtacgcagggcggatgcaggtgtaagattcccccccttaaattttcaagaatagataattttttgataacaataaaataaaataaaataaaaaatagtttagacgtttgcacgaaaggagaaattgaaaagcatagaaaaagaataataaaaaagatgaaaaataagagaggagtgagtgtgagtatgtatgtttgtaatttttatgaatgcagtgatcacactcttgttaattttaagcaccagtcacacgctaattttgtcaattttttctctcttaaactgaacctttttcacacttttattataattatttgtttctttattttttattatgtgcccccttacttttttttccggatccgcccctgtacccacgtacgcatgcaattaattaatatttgttgatggatggctctgtcaggagaggggtagaggtagagcattacctaagtttggggactcgggagttctcggtaatcttcaacaatgccaggaatgagagaaggagtggtgctaataacatgtaacttaattaccttcttcttgcttcatgctcaatcccggcccttacgttacgttttttcaaatccatcattgcagaaaaaatggttttgctgcatatgtggtgtatgtacttgggctttagttggatcagtagtatttattgcatcatatactggtatacttctctctctattctttatagtagagtttgatatttgtgtataaactatatacttatttattcgatcgacctgcgtactattttatatatttcttattggattaactgttttatactaattcatctctctcgaccctcggtcgagtcacacggaaaaaaacaaaatcataattacagaaagttgattgcaatgttactaaagagatgccagtcactctcctgggccaaagaatttattcttaattttaaggatttgatattcaagtgtgtaaactgtaaagtgagaaaatggatatgtatctatccctaattgaaaatttgatatttaatttacataataatttgattcaaatttaagggttaatgcacgtacccttacatacctttgtcgaggtaaattattcctttaccggtgcattgtacttcgtgaatttttcctgttaccatctatacctaagcttagttatgagccaatccgcaatcctattttttatcttgtttatttttaagctataataagttcttaaatgctgatagaggtctatttttttatcaacagcagcaattattttaaattactgaaatgggtataaattatataaatgaataagtcgtgttgattttagtaaattaaattttacaaaatatacaaagtcgtgtttaaaacatgactttttttgttcaaagttacgttttataacacgatttacctttttttttaaaagaaaagtacacatttcggtattttttataataaaaaaaaaatacgtgtttggtaaagaagccgctgatagagttagagattcctgttaaatatggcacgactcgagaatgtaggttaccactgcaacttacattcaatatctgagagagatcttgctcacaaaatacatatgaatttctcaagagccgtaacaacttaagcagctgaaatagagtgaagggaaggtggattggatacttaccggataagaaaagaaggagaaaaacaaatctaatattctaacaattaacatttaccgattaaaaaaactggcagaagtaaagtaaacgaaaaaaagatgaataggacatggtgggagcgtagaaatggcctgtcattttttagtttaccggaaaaagaaatcaactataaacaacattaaataacatatttccacatgtattatgagtaggattgaactagttatataaatatccatgtgatgacaacggaaaaaagtttaaaataacattctcatttgtactgttacagattctcagaacatttcgaagctctaaactctcgaggtacccaactttcgttcaaacaatcgctgcagaaggtagacttgcagcgcactagccccaatcagtgctgctgattcaaaaattgccttgtgtactgctcttttgctcattgcatcgttcactgcattccagacataagtgaacatgatattgcatccgcagtcaagaagtgttaatagaaggaagaaaccagtttgtagcttttatcaactacgatgcttagtgtatttgttcagtaaatggacatttcaccataatcaacagtgaacagtgaacattgccaaagagatagggagcaatgttctcaacagggaggtctcttttggtatggtatctgaataaattaggatgatcacatgttgggacatttgttcatattaaatggtatcaagaatagaaaacaagagggcatacataaacttgggtttttatctttaacacgagtaatatgtataattgataggtataaaagattttatgcacagaaaaatgtaaattgtgcgataaacagcaaagtaaaccttaaataatacctattgcttggcggtcagtctgagcctctaaccaatgttgttcaaactggatgttgtatagagcttcctccaacttcccaatctgctccagcaaaggggtgaaatgctctgcagacagtcacaaaaagtttcaatgaaagttctcttattttttagacttccatgtaacttaaaagagcagtgttttacattttttttaaaaaaaaaaaacagcaaatacaagtggacctcatagaaggggcattaccatcttttgcatgttgctcaaagtaagagaagtgaccaacatgtacatcaaaatcaacagtttcatgataaggagacttgttggtgaagcagaatttatggaccccagatttgtgagccacaaaatcgaatttctcagttgccttgtcccgaaaatcttgtatttgctcgccagaaggtccctttacctgaaattcttacattgtggtgtaatgagattccaacatatgattgggtaggtattaaggaaaaagaaagaaaaaaagcatttcaaagaaagggtattcctaacaattgtgtaagtaccatttatatgtaattgtaaatgtaaaaggtgatacatgtaaattgctacatataatgcacaacatctctatgaccactcatccttctctaaattaaagaactactgttttgaacaatgaagttatctcctaaaccattgataaaactttttgcttcattaggtgtttgacaagcattcgtttttcctataaaaactgtgaactgttttgcacagtgtagttatctcctaaccgtggcttcattaggtgtttgacaaacatactttttgcttcatggtcaatgaattaaaatttccagaatggagttcaaggctttaagcttaacaacggatcccaagatctagaaacaaataacagtttcatggttatagtgaagaatagcacagaaagcttcttcagcccagagagctacataatagctttagcttcacaatataaaagaataaactattaattttgtccctcaagtattatcctgtctattatgagagtagtctctggaataataaaaaaactatataaataattcctcaagtattgaatattcatcaatttaattagtctcaaaggtgatgcattttagtaaaattcagagaccaatttgaagggccttttaatacttgggggactaattagcatgatttcaaatacatgagaaattacttatataggttttttacattagggattacttatgagaaagggtagtatttcaaagatgaaattgagggtttgttccaatattaaaccctaaaccaatagccaacaggtaggcgtaagagaaagcaattattgttggttctctttgtattcatgtaccctatggttctattcccttccctaaacttcctgtcaataatatatatgataatattaatagcttgagtaattgtgataccccttgaaagtgataaagctgaaaataaaagcggtaacatagaatgagatggagtgaaaaagaacataccacgagatcgacaccttcgtcgccgtaatgccagggagaatcagccttaataacaacaaaagagacatgaacagtgtcaccctcgtactttacatcatgggagaaacactcgtctctgtctatcacaaatcggataccctctgccctttgcaagttccacaacgccccaattaacgcaaacaccaaagcatgcctcaatgataacctcatctgcaaaacaatcgattaaattcacacacgtctcaaaaacacggatccacaaaatcaaaagatatatagataccttggtaagtttctcttctcggaaatttgaagaaaaggatggagatgaaacaagaaaacacaacacaacacgacacacgcagttgtggtttttaatttcaacgtgtgtttggttcagactttaaaagtgttttgctggaaactcgaaactggaaaacggcgtcgttgccctaacttcggcttttctaatgtgtgggtttttgattggacggtgtaagtcatcgatccaataacaagttcacacgtaggatatgtttcaaaaacaacaaataactctcctcgtcttcgtgtgcgaagtgcaaactaacacacgtaagctgagttcagaatctcgtctcgtatagcaatttgattcagatcagatattttttaatcaaataataataataataatttttatctgtgtaaatgcggaaaaaaaatagttgaatgtagtggtgtataactttctcatattgttatccaaaattcattttttatttacgtaaaaagtaaaagaatcatgatatgttaacgattatggttaaggcacttctagttcaaaaatatagtgcatataaataaatttgtaattatttaaaatatatttacgattttatatttttaatatgataaataattatttttaagaaacacctttttataaaaagtatgcttaagaaacaataataataataaaattaaatcctaaacccaaaatattttttataaaaagtgttgaaagtaactaaaaatattttttaaggttcaaacttttaaaattatctttaatcatattttttaattttaaaagtttagattttaaaagttaataatcaaagactaatttgaaataaaaaatgacatgtaatttaattagttaaaaattaacaatatcaaaattccaaattactgggacaccatagaaattttaaaattacatgtatttagactattaatattaattatgaaaataagatttatgatattataattatagatattaattttttgaacgtatgattttaaacgaattgaacctataatgggttagaccattactgttagatacttctgttcacagtttattttgaggtaataacaagaattcgatattcttttcaagtacatgcctattaatgttttataaattataattatcattatatgattatgactgtgcataattttctttaaataaaaaattgtcgctaaatttgcataaacttcttcatcattacaattattaatttgtcattataaaaaaaaacaaggatatatagcatcatacctctgtagccaacaaataagtctcaaaaataaaatacaactagcagatgtaagaacttaagcctttttaagaaattccataacatgtgtgttgagaacacaacatgctattcggaaaccatggaatccagctcctttagccaaggccttgtactctttttctgttctctcttttccacttgggctatgacacaacatgataacatccatttgaaactcacaccttgcagctaagttagaatctggggtttctggacaaataccttcagccaaaatcacttttccagtgtcgtcaggaagggaatcataacaattcttcaacaatttcaagcattgctcgtcattccagtcatggcatacccactacatacaaaaattgtattgtcatgatattattgaaatataacattttaacttggtttggctctttccaaatataatcaatataaaaacttgaaaatggactgtttaccgaatgaacatcatattaataacataccttcataaaaatggcgtcaccttttggaacactcacaaacatgtctccaccaatatgttccacacctgcaccaaacccccatattagttctataatatcacgtacaacaaaaaatgtgataaattatttaactcatcttttaaaaatccaaccaatcattaaaatattaggtgacatgaaataccatattaacaaagtcataaaaaataaagttaggttaattttaaattaacataaaaacaccatattataaattgtgtaagataaaaaaaaatcttaataaaagtgatagcaattcatcaataaaccttataaggccttaatttgattaaacaaaacttggtgagtaaaagaattttaaaattttaaaatgaccagttcccattgataattttgagttaagagacttgccatttggtcaaattccgatttttaagggttcaaggtcgttgctttctgcacgctttgttggctttcggactaatcaatccgaaatgtaaaattacattccaaattagtaatacattttgatttacgaactgaccaattcgaaagaaaataaaacattcctgcagaaagatgcaggaagcaatagtctggatccaagtaggaaaaccaaacaacacttcaaattaacatcccaggcccagcaataaatacaattattatatacaaatgatgctactattaccaaattaattatcacaggaatgagaatgtaagaaagatccaagttagaacactcgcttagcttattttttaatttttttatagtcagtagagtcaatccaaactcgtaagatatgaactaaaaagcacctgtataagctggagcttctttgatgacgtggggtaagtcaaaattaacacactttgtggtgggatacttagaggcaaccatattaataatagctccagtcccaccgccaacatcaaccacagatccaacaccctcaaagccattatagatctcaagaattttcttcattgtgatgctagagatatcagacaatcccttattgaaaagcttgttgaatctaggatttgtgtcatggaattcaaaggcagtcattccataagcattgctgaatggatgcccaccctccttaactgaatctgtcaagtggtacctacaagaatacagtcctttaaactctatatctaagacttcactaatcactaatcactaaccactaattatatatataaaaagtttcgttgcaagtatatttgatttatgctgctgacaatctttactttatagtgacatataaaactataaatatcattacaaattctcatttttaggtgagaatcttttctttagaggtaagattatacgaaagaacatataaaaggctagtatagcaccaattaaggaaaaaatgacaaaatctgttaagataattttgacatgtaaagaaaatcacaagagatgtcacttaaaaaagtagattgcattgattttagtattgtgaaaaacaggaggagaccaagaaggacattggagcaagttatcaagaaagatttcaagttttgatttttaaacgtgttgaaagatatcatgtgatttatatagtcaatttcacttagttggataaggctttcttgttgtattacaaattaaactctcttctttatagtgaagttacctttgacatctaagttcattggctaaaattttgttggcctctttcttcaattattttggcaaaaatcgcaaaaaaaaaaaatcctaagcgttctatctatgccgttttagtcatatgggcaaaggtgattatagttattgaattattcatacttaacattttatatcaattaatgggagttaactgatacctctaactctaactttgctaatacaataaaatcaaaagggccagaagaaagagagaaaaaaattaaaaaaagtgttgaggaatagtgaaacacaataccacatgtctttaaggactttgtcctgttccatgagaaagtaagcagccacagagacaccatcttcattgttgacaaggtatttggcttttgggtgaagaccatagtgcctttcagccttaccatgaggcagttgatggagtgtgtaagtatgttgtagctagccaagaggcgcaacatgcggtccagcatagaaggtgcgtgagggttctttattgctgggatctcagcagctatatgagaaggggaaaggtaagctccaggacctgccttggctatagctccaaagctgacttgagaaccatggagacagcagtgccacccgctagttccatgccaaacaagaaggcttcttcatctgatactacctccattctgtgctaccttataatcactttcaacaggtaaacttcagaatgactcagaatctaaagtcacacattagtcttactgttatcaatgaactaacaaaattataatctcacagattctcacaactcacaaagactcacacgcagcggaaaaaatataaaccgagagagagttatctaacgcgcacacacactaggaggaagagagaaattcagcttaacttttactcactaattccttcactcactgcatatttttaaaatgttacatgggtggcctttttataggcaaagttaatacaataaaatattataaactaaatggctaagaatgaaaaatggtgcaactatggaggtgccgcaattgccgtatcttggacaattcaattcagtgacttcttcattcatctagtgaggcggttgcattttttttaggcggtgaaaatttgctttatgttgaagtataaatttgcttgatttatcttaccgacacttactaaccttaattaaattgctccttcaaatgatattttacttgaccaatatactttagtctaagaactgtgaaagcttttgccactggaactcctccttttggtttagaaacacctgaacaggagaaaacaaagttttcagaagaaaaaaaagtgaataatactatttgatatctcagacagcaatataagtttaatgattgagtaatcttagatagtttaaaagaaactgcattgagtaaatattagttctgattacaacattatgtaagtcagtccctaatataattatacatgagcagtattcagttctccactgtcaacctacaggaaacctgtgaacagaaaaaccaggtatacttttcttggtaaggaaactttggctacatgggaattggcttaaaacactatctgcgtgtgtgtgcaaccccttctcactttcagttgtaaggtaaagtaataactaaaaaggagctagtcctcatgaaaaggaatgatgcaaaaaagtttatgaagaaccctttagtcctttcgacaagcagaaattaagaaaagtttcagactaaaagccattataccctgcaactacctcataaacagtgagtagtttttataaattactatttatagcaattaactcttaactaccttgctgacccatgtaaacgcaaaattaattgacttgtgaatcagttgggtttgttatcttcatatttcctcttgaatacacttcagtaataggccccttattcctgacaaacacagatgcaatagaatacaacttgaatatggggatacaataaattctaaaatcatcatcacacaacacgtctacaatacaacgtataaaattagtagtacaaaattaacataaagaggtactaaaagtatttaaagtttttatgctgcttgaattgaaacacaatgaaaaacccgagagagggtgagagatcgatgaaagtgagattgaacctgagagaggttcaagatcgagttgagagggtgaaagtgagattgaacctgagagaggttcaagatcgagttgagagggtgaaagtgagatttctaaaacttgaattataatatttcaatcatgtgaacttacagtttgatatgctcaccaatttataaattatattatgtttataaagttaaattgattatagaattgaaggtaataactttattgatgtataaattttattatgctttttaaacatattattaaattaaaaaaatgtcaaatcgattgaaaaaaaaatgacaataagaattgtccttataaaaccaaatggataagtcctcatttcacaatcttgatatcatcataacatgtattaaactaaaggtcatctaatggataatcattaccttcattttgtgatcattaatcaatcaataaaaataatcaaatattttaagatattcaaatacactttaattcatgaacacaagactaagatgaactcatgtttcccaaattgtaaattcaaacataataagatggataaaaagtaataacaagttgaaactaaattactgcatcatttcacaccggtaataatcactaacaaaattaggcatggctaaaacatctatgcaaatgatgatagcccataaaacttgagcagaggatcaagccataaccgtaatcaaagaaaagaatatacaatattttaacttaataactcaacgccataatttgttaacatgattaatcaaataaaaatagttcacgtcatacaaagcccaaaaattcaattttattgtaatttggtagtttttattgtcaagcaatataaactcaatacttacagttaaatatcaaaaaactaactcatagatagcaccatctattgaattggaggatatttttgaaccaattaaaatctatcaaacttcaaatcaacttaaagcaatatcacattatcaaaaacatatatatgattatgaaacacaagacacgaaagatttcattatgataaataatgatattatgtcatgaaggattcaataatttaagtcctggtacacaaactaccaatgtaaatacatacatgtctcacggttaaaagcctttgatcaaaatcaagcaattatagacatacaattttttttaattctactattttgaagtgttaaaagaaaatatattcatggaatactataacaacatattgatgatagaaactgagtgataaggaagaattttgatgatgcatatatacaacgagaaaaaatgttagtaatacacagacaatttttataatacttaatacaaaaaaaaatttaacaaaggagagtctagaaaaatatctgagttgaagcgcgttatgcgctgtctttacgacaatccattaattcaatggagtgcaacgaaatgatcttgaaccaaagaacattgggctccaaaacatataattgtaataatataatataatttaataaaaatgagaactaagcaaatggtattttgatgtaactgtgtgcgtctgaattttttcttcttattttttgtaagagaaagttatatataagaagaagcaaaatcaccaatatgcggtccaaatatcacacctaacaaactaataacaaacataacaataaatcttaaagcacaaatattttccaacaccaaatcttgatagtttaaaacaacaaatctcaaactccatatatcataatgaaaaatattttccaacaccaaaaccagggaatatcgtatgcacttggaagtctatctaaatctgggatattgcaattaagctatttgctgctgttatggccatttagcttaactgagttagttgcaattaatgatttcgtaaggcaataggtgtgccctccaaagtcgtgaatgaattaagatgtaactactagtagtaaacctgagactatcgtatgcacttgaaattaagtactactttgctgtctacctgaatctatgacactgaaaatgatcgatcaacatcaattgacaacataaggccgtttttttcaaccccttccacattttgctaacgtacttatccttgccaacattaaagggtgtggccgctggcgcgcgagcgagggtatgcattgcgtgtggtgcaaattatttatagaacacttcattcttctttgcacccgccatatctaatgggaggtgtttagtggatgagttccttcaaaaaaaattgggtttctaatataagaaactctttttagagtttcttatttttcaaacatcaccaatcaagaggattttttgaaatttattgtaattttttgcatttgaacaaaatttgattagagctcttataagtgacatgacaatgtaggaccacaaaaagatgagtaaataactttaaaaaactcatataagcacctgctcttccattgcaaaacaacaaggcttcgtcatcctctacacttacctgctgcttctgattcactcccataactgcttcctcaatgttgttctaccactgccacatatttagaaattgtctcgtacaaatacttggtttcaacttttctccatacgtcataaagtctaaaggagacaccattgttggtaaatgaaattctcatgattatcctatctaacattttcttaatagttcaaatgtactcttgttttcaatttcattgagatataaaaactttttatagtttgatttttaccctttttaattttactatcccttgacttaatacccatattaacgacagtgtatctaattacaatttgtttatattcaaatctttaaaatcgtccaggtcttattgtgaaaaaaaaaaaaaagctgccccgccacagcaggcgggttgcttcctcttttagaagaacaagaaaacaaatgttttggtgttcaaaccaaataaattgtttcatttgataaatgtttagaatcataccagtatggtagcacaattttctaccaacataaatctacataaaatgtattttctacttaaaatctaatctatagatatatatatatagtgtgtgtgtgtgtgtgtgtgtgagagagagagagagagagagagaatttaatcaaattttagcttttaggttccaaattcttaaatttatttcacaccccaaataatgattaaaaagttttaacttgatttactttattttaaaaaaaaattgcttaaaacaagttcaaacaccaaaatcacacataatgtatccagtatccgaacaaatatataaacagaacaaccaaattatatatcattattctaaaaagaaagcgtgtttttggtcaatataaacagaaacataaaaaataaagatatcgaataaataagaccaacaatgggctcaattttggagaataattacaactcacttgatatttcgttattccttgggccttggctttgaacatatgctgggccctagggtgcaacactgtcaaatgtcaataaatattagcagatatgcgttaattttgattttgaaatacaagcaatttgttcaccttttggtatgagcatcgattcctacttattaaaaagaaaattttgggaatatgcaatggattaacgtcaaactgtttcactgaatcatttcatgccagctatttttgtttaccaaacataccaggtaggcaagtaatattattattattattatttaatataaattacctgcttcagtcccattagtattgtgtaaatcaatatcaaaaaattgtgtttgactttattttatgtttttggtgaaggactttatacgtcacatttcacttacgaacgaaatagaaatttcactatttcagtaatagtaatgatactagtgtagcccatatttgggtggctatgaaaagtgtagcatgttttacaatgatttttatttatttctctcgtgagctacttcgagtacgttgtagtgttgtacacagcaatgtagccttcagatccaccattggttgaaaaacaagctataaatgacaaaaaggaatagcataatcgaaataaaattaatggtgataatgataaatgtcaaatttattgaatttttatatatattttgtgatatttacttgacattttagttaactttagactttgttttaaattcagtttttattttgtcttaggaagaattttatgttttagttatttttaataaatttttttatattttttagcaaaataatgggtaattctgacaagagttccagaggttcaaaatcagtagaaaattatgtaaggagaaattgtgaagaataaagataaaactaggaaacaagatatttttcaatgataaatcagatgaagaataagataattatttgaaataattagagatattatttgtttgtaattttttgtaatccttttccttattaaacctaattacaattctataaatagaaggttaaagtatccattgtaaaatagtaaagtcccgaacagtttttagaattatattttagacttacacctactagacacattcattattctattagacactttagatttcattgtattatttttatgagtgcaatttcttccatctaggaaaggaaatgatgaatcttgtttcactttaattttatcaattcaacacttcatcttaagtttttttatttgttttcatacttaatgtttttatttgattggtcatcttatagataaattcaagaattgacttgcgctttaacgagcctggttgaaactcgattatgaattaagtacttaattaagattatctcgagggatagaataatctggattaaatctcgctaattctcgaccattgatgttgattgtttgtatccatatgtctaagggattgagtattgggcaagtagtttagaatatgtgaccattcaagagctgggtagaatacattagtgaaccggggatgaacatgagagattactagaaaattgtgaagttacggtggatcgaataaattccaagtccaaacttagatattcattcatcaggatcaatgtcaccatcaaagtctaatatttctatttttacttaattattttattgtcatttaattttattgtaatttattttattttatttatttcgtgacaattacaaaaccaaaatacaaaaatataatttttagttaaataattatatgaaatttctgttttattattttaaaaaataacctgaacgataatttaattagtacatcgtaattgagttacatttaacctataaattaaatctaatatgaaataaaattttaataaataacaatcatactatgtacatgtacgtgattgttttagcttttgtgatccacgtttaatccaaattcactctaaagcaacctaaaaacaaataaaagttatttcatggatctacgtccaaatatcattggacagatcaccaaacatactatataaccaccacatccaaagtcatatgatctgaataatattattttcactatattttcacaatactttaacttttatacattttttctctatcactcattatcacatcattttatcttattttacacttttcttcctattcttcctatgattgttcttgttgtagaaattgttaatattattaagccttactagataactagtgtacaagtaaaggatctaagatccgagaaaaaagtctaaagggaaactttattcataacctttgctttaacaatgcagtatttggatattataagagtaagtattaatttagttctttttaatttgtattatttgttaattgatactttatattataaaaaaaataaaaatcaaaagtaagatattcttgtatttaagtaatagtcaattaatttggtctatgtaattaatgatattgattagattatttcttaaagaatttattatatatatgattgtttaaataaattgtttatccatcttaaatttataagatttataatatcacgtaaatttaaaaattttacacaaaaaattactttaatactaaagttactacgataactaaattttttagttacattaaattttggattgaaaaaaacgttatttttttttagtaataatcaattaattgtataagtaactcttttaaacaacacattatcaaatcatcatctccaataaatttttttattaaacaacaatatgtaactttaatcaactcatttaatcacccgctttaaaaatgttgtcagtattattaactagattggtttaactttttttactttagtaagccaattcaccggtctttgacgatagacatcaattaaatgatacacattcatttcatagatcaacttgatattcattctaataaacttgggtggagtttttttttttttttttttctttaggaataaattggtgaaattgtgaaatatacaacgttctttatttttaattttctcttcctcgtagctttttttataagccttgcacgagaccactttcatagcgagtttttccttaaataaaaatatcataataatgacataccacgtgaatggtctttatctttgtaccaaaggaagtaggttggtctcatcagtgtgatgtgcacttattgtttccttttatttatttattccttttctataacatgttttgttatttccacgatttaatattcccacgatagcaaaatattaatctaacaaattaatacatgagaatcttttataagttcagagttaacaaatatcaaaataatgtttgtttgtacgaaataagattgagagaaataatcttataatttttatagatattggaggtatctcattttaaggttgcgttaagtccaacttttttaaagtttttggtataaactataggtatgttttatgggataaaatttatcatagataacaaatttttatttacaagtactactatttaaaataatccctcctttgacacttcttatatatatagatatatatttttaagttagttaatataaaattgtataataacaattaagattagttagtgtaaaatcatgtaaaattagttgtgtttattattatcattgtaatgtttaaggtgataactagagtaaaattatgtaaaattaattatctgtttgttatttttatgataatggttaaggtggttattatttaaaataaaaattagttctaatttcatttgtgaaaatagtaaatttttttttgacatattattacttattaaaagttagatatttaaacaatttcaaataaaggggaaaaaatcaactcctttaacaagtttatggattcatccttgtttatgtcctctttgaaataggtgataaataaaagatatttagtaaaaaggaaataggaaagagatgagaaaaagagaaagagagattaataggaataggagataaatagtacattgaatttcataatttttaaaatcattttttatttaacttttttttttacaaaacaatccaactagtaatttgtatctgcccctcttctcccaatttatccttcacaaaataagcgcttttaatgtaaaagcttaaaataagggtttaaattaacaaagtaaaagttgtttgaaaattcttaatttttagtttgaattttttaacctatttaaaattaatttcttcactcaatgaatgatcagtgtgtctgtgtgtgaataatcaatggcacttacggtgttaaaaacttaaaggttagcttcgtgaagtcttttagtttgcgtggacaaattaatacacttgtttttttttccggctaattaataaacttgttaggttagataactataaaaacaaaacctgtttataagttttgtccttataaatatagactattagactgtatttaaataatcaagattttaagaaaaatgtacatgatttttttaaaataatcacgggatcacaaactaacttttcgtttattcaaaaaataaaaaataacttttaatcattgaccattcatttatatataattgttggaccaaaatttataactattgtttacaaattatatcttaaaaatcgaatttgaattcttagattgaaataatcctacatgaattgattgattcatgatttttttttttaaaaaaggagaattgattcatgctaattaatcgtatactgttatatatatatatatatatatatatatatatatatatattagtatattttataaatatatttaaaagttatatggatgaaatgagatagtgacggaccgatgaagaacggcttaaatttgtcgattccagaagaatttgggacccacgtcgacatcaaccggccggtccagcccaatgtagaaacgaagccggcccatgccacaagaacaaccgctgaggcaatatctaatgcctcgtttcttaataaacaaattaacccccccaaattattcatattgactggaccaataaaacgattaatagcctttttcttcttcttcttttgtttaaacagtattaatggcaacataactacagcattcagttttaaataactgttaatttcccccacaaaaaaattaactaaagtgcattaaaagtcagtgatatgtactttttagataatatttataagtttaattttgatttataggatttttatattatcatctaaatataagtaaaacaaactaacaaatgatagcaattattcaagagagaaaaaatattttgagtaatatttcttctaaattcatatataaaaaaaaagtaatttcgtatattggacttaaatataaataaatttaactattttttatatttaatgttattattattaaaataatatttcattaaattctaattataattctattttctatgattctgtattatttgttataataaatgttaataaaaataatttaatttttaacttaagattagtcaaattaaataattttatttttgtttatataaaatatgttacatataatcaatcgaattctccgtctggcatcataattatctttacatggtgatgtaaatagaattggatccgataaaaaaaagcattatgataatgaaacaggttggttgaaagttgaaacttttgcagaggcttatccatatcacaaacgccacacgtgatttcttccgtttggcgctagtgaaatgacgagcctaccaaacaagccccacattattacagttttgctcaaatccaaacaatcattttgtgggtcacatgagtgcaaaaatatatgtcaacaaaacaacgggtcctcacctttctccttttctatatttcactttacttttagtaattaaccaacaactaattagtatggtttaagaaagaaataaaatctgagaaatatacgggaatttttattttttttaaatatttctttttgccaaaaaaatcatcatgaggtgaaatgagaatttaatttaattttatcatttctttttttgcacatactaatatataatatatattttataaaaaaataattctcttaaatcaaataaaattattataagtaataatattctgtttcagatttgatttacagttcataaaattaaaccgtaaagccgtaaagaagtataatataagagtaaaatactttttaatgtttattgctacattctttaataaaaagtatttattgctatatgaaataaaatatatatacattcaataacataagtagattacacaattatgtcagtttattattgaaaaaaaaagtatttttgcttatgttggggattcttaaaatcgtgttttgctatatcggtgaaaataattttattatttttcttatttgactatcagcatgaagtctttgacacgacttattatgtaactatatttaaatattggaaaattttcttaacactctgcttgcacgttatgggcaatcggagactaccatccttgattctgaagatttgaactattccttcttgctcttgattttgactttgtaaaactaattgcggacaagttcatcggttatttttaaatagtaaagtaaagtcaaatgttactctcatgaaaactttaaattaattattaatctcccatgtttattaatatttgaataataaattaaaatgaaataataaattttattttatatatatatatatatatatatatatataaagagaattctataataagtactttttacagaaaaaatacataagtaactagagagattatatcacaacaaaaattatgatgaaaatttcatgtcaaaactattaggatatgtgtttacttaactttcatttgaacaacccaatgcgtgtttggaaaattttacattgatgcagtagttaagacaagtaattttgggaaatttttctttacgcttaactcaaaattgttattattaaactttcacttcgtcttaaaaattgagtatgagtttaaaagtcctggtgattggtgctcatatgcgcataataaaaaatttatcatattttttcatgctatggattctattattaatttttatattatatcttaaatatttttaaccaaatttaaaataaaaaataaatacttaattagaccttatacatttattctgttgattactatgataatactactgagtggaggtataaaattgatccaatagttgaagaaaaatgaaaagaaaatagaggaaagagagatagtacattcaaattctttcactaatattttcaataaaataagcattcaccaataaaaaataatagtactgcattcttttaaatatcatcacttattagtattctcatactaattgattacgaatatcttgaagtacagtgctaaaataataaaataaataatataatgattgaaataaaatatataatgtaaaaatatccaaaaaataaaaatagcacaaagaaataataaaattttatccaatgtaagtaaaggagaaagttaataaatattttaagaataaaataaaaataaaataaaataaaataaattataagctagaagttaatatctaaaaaaaaatattacaaaatactaaaaaaaatgtttatcaaatatacttttgtctctaatataaaaaagttaaaaattaagtaaaatactcaccaaacatactctagaacaagagaaatattgttattacttatttttgttataatgtcaagtctaatttttaagaagagtatctattttattcgtaactgaaaattcaacacatggaggaataaaaaaaaaacatggtgagtaacaaataatctacacaatctaacaaggatattcatgacattcaaaacaccttttgcaatataacgtaagtctattgatattgatgacattgaaaacacctcttacagattcttcttcaaactttcctaaaatttattattatacagagtgagtcttatgcattaaaataaaataaaaatgggtatgaaactctaaaaaatatatatgtgatttaaaaaatatatacaatataattagacatgataacaaaatgaaattagaatgtatatggtttcttgttttcgtctcccaaaatccatcccaacctctattttcaatagagatgattttttatttaatgttctcatcgactattgaatatatttgttccttatttatattcgccctagaattttaaaaataaaataaaaaacataaaaaataatttaagaaagaaaaaataataacattttctataaaatagtgtcacccgtatatccaagaattttttttattactttattatatatatatatatatatatatatatgatctcaaatttctattcctattactaaatgaatttaagaatcaatcatcacctattaattattgtaataaaaatcttagaatgacatatttaattacaaagacaaacgataacaaatgttaattaagtaatatatattttacataaatgaaataatttatcacacaatatgaatacgggatattacatactcattatcgtttttcaaaaatcaaatattacctacatctgtatccatcccacaaagattctctggcaaactcagaacgagaataggatgatacccacagataccaatttatttgtcatgactaaatataatctataattctgcactatatatatatttttacataaatctttactatactttaaaaacattatattcacaaatatacacttacatcacatcaccactgtacaaaaaaattacatcactataaaaatactaaatctcatcataaattgtataattaaaatatccttatcgacatttacatgtatacctacaaatgaaatatttttaactattttcaacatcgtgtacagtaatggcatttacttacatctcatttataaatcatgctatatctttctttttgcttctaatcatgctatatatatttttttcccttctaatcatgctatatatatatattttatttttttttcttcttcttctaatatgctataacttagtaccactataccagcacgtttttttttattttattttatttatttttatatataagctattgagagtaaaacacttttttttttccaatttgaaatgagacggtgcatgaaaaggttgttgatgaatagaataatcaaaacaatcattttctttgtgaaattgtggcatctgaattttctggttcatttttatgcataacgtgcagttaacaaatcagaatcgttaaaataaaaaaaattaatagctcaaattctattataataaattaagtttaaaacatgaatttaagatatgaattttcttatttacatctgtcgatttagatttaatgattacattaatgcctaaataaacattgcacaaaattagttttttacgcttgtgcaaggcttgtatatcatctgaacggatcatcaaatttctttttgttattttgattttaaaaaaccatagttaaaaattaataattgttacttgaatatcaaataaaagaaaacatctctataattaattgttggcttattaaacaattatttgatattcaagtattgtttaacaagacagagtattgtttaataattttataaaataatcttttttttgttgtccatatataaatgaaaaatatataataaatattatattaaaaaattaaaataattattattttaatattctttttatatgacaattttaataagacaggtgaagtaacatctataaaatacttgtcatttttgtgtaaaaacaagcacctattatttttattgttggcgatatttttgtgaatgatgctttgtataaaatttcactttaaattcttttaattttttcttaatttttttatttataagaatatttatcttttgaataaataatatatgtataaataatgtaattttgtttataagatcatctaattataaactatcgttacttaaatttttttaaatatgtaagaattaaagataggtatgagaaaaattacaataatttacatatcttaatcaactaattgagctactcttaatatttatgcagagttatatgtttaatttttaattatttaataaatattgatataaataatagaatatgcaattatgcaaaatagaagtttcaagaataagacattatcttaaaaagtagaaatgtaaaaagtacatttaagtcatttaacatattaaacaaaataatcaattatgcagtttaattgattgactagacagtcatgaacttaataaacatcatgaatatcttctttaacgttctaattcttttaattttttaatatatgaaaaaggtgaaatttaaacgagtccccgaaaaatcaaaccacataaaaagccgagtgtatgtagcaaagcgaaagccacccaccagctcagatcagcctatttctccgttctgtttttacactctttccatgcaaaattcccccctaaatttctgggttttattcttgtccctctctttctagtccattcttttgttagaacactcttattacccatttcaggacttcacttttcctcatcattcctctctgtattttacatccatcttgaaggatctgtaattttcctgttttctttttcttttttccccattttcttggcacttttgttttcctgggtctcatattatctctctgtacctgaatattcaaccccctacccctctctcccccatttcacatttattaattgttttcattagactcacagaagagattttttgagctcaatacatcaaagtctcaagcttcctggggattcgtaaagggtctttaaaaaaaattccccttttgttatatgttttgaatccaacccttgtttcaccaaatcttgtttcacccattttgtttgcagcctctcctcacctaatctcaagcacccaggtccacaaaatggaccatttcacggtttcagactagtgggtaagttttcttatttgacaaggtctttccttttccaattcaaaagacaaccttgtctgaaaaccgaagccacgccaaaccccctttcgttgtggctatcttccattcgttcttgatctgacacaagaaaaaatgtatggaaccaaaagcaaaatagaccttgcctttgaataccaatcccaagttgcagttttgaggcccagtatccattccagaagagcaaatctgactgtgaaattccaagacctttatgggttcacagtggaagggaatgtggatgatgtgaatgtgttgaatgaggtaagggagaaggtgaggcaacagggaagggtttggtgggcattggaggccagcaaaggggcaaattggtatttgcacacaaccatagggcaaggcagtgccctcacatcttcattgaaattctcagcactggctaatgcaataactttgaagaagttgataaggaaggggatacccccagttcttaggcctaagatttggttttccttgtcaggggcagccaagaaaaagtccaccgtgcctgacagttattatgatgatttgaccaaagcagtggacgggaaggtcacccctgctacccggcagatagatcatgtgagcaactcacccccttttttttttcatgatcatcacacattgggtttgcttttgaatttgattacaattttcataattgtggttgtgggcatcaccctttatttgactagtgcttgcaggtgtgtggatcattttcaaatgaatttgatgcaggaattactttgtctagactttacattgtgtgacctgtgaaaagattttcagacaaaattttgctgcagattttgatggatgattgtgggtgttttcttttttgtttttcttcgaatgagcaatacttattatttatgaatgattcggagagttaaggaagatctaagagttgaagcattttttatccctgtgtttgtaacctttacaatcataagttctgttagccatattaacgtatcccatttaaataatttatttgttcttgattgcatggaatttaggttaggcaaaacgaatctttgagtaaatgctgattagaaagaaattgtaaattggggtggtatttgatacggtttgacatcagggtgtttgatgtgatccttaaaatggtgattggttttttatttttgttcgagaataatttgaacttgtctacatgttacattgttcattatatatatttattttgcttctaatcattctataagcatttttgcaggatctacccagaaccttccctggtcacccatggctggacactcccgagggacatgctgctctcaggcgtgttcttgttgcctattctttccgtgattctgatgttgggtattgtcaggtgggtttgctctggcctttcatttgtagttttgactccctgctcagtacatgaaagacaatgttctgatttgttattaaattgaaatttgatactacctatgtcttgtattaggtattaggtattaggtatttgaagggaaaatatcttgtgtcttttttttgagacgatgtggcttactctttgattcaatcaactctgcttctattctttttcttctgcaattagatattctgtcttctattagtaacatgcaggcctctgaatgcttcctttctaactaattaacaacatggtgtgactaaagcggggattagtttttatgttgtacctacattttgtttttctcaattgcttcagccactatatttgatgttttaaattttttaaggcaggtaaaatatagcgccacaaagtttgacaataatatgtggtttacttgaaaattaaaaaaattaaatgcatacttgggaacatattttcttaaatattgactctactataatattgctccagggattaaattacgttgcagcattgttgttgcttgtcatgaagacagaagaagatgcattttggatgcttgctgtcttgttggaaaacgtcctggttaacgactgttacacaaacaatttgtctggatgccacgtggaacaaagagtgtttaaagatttacttgctaaaaagtgtccaaggtaattttatttgatgtgttaactgtgtatcatatgtttgtttcttagtatcttctgaaaattgtagaaatggaaattcaggattgctactcatttggaagctttggaatttgatgtttcccttgttaccactgagtggttcctttgcctcttttcgaaaagcctgccttctgaggttagagtagtgctggaataaattattcattgaaaagctaaattgttccacatactaatacttcttccatgaatcagacaactcttcgcgtgtgggatgttatcttctatgagggtgctaaggttatatttaacgtggccttggcaatctttaaggtaccactagtgtagcctttttgatctttcttgttttttgataaacacacaaaatatagaaagagtttgctacattggaagggatgtttcaacaattgtcgccccaattgcagatgaaggaagatgaattagttataacccatcacgttggcgaagtaatcaatattctgcagattaccactcatcacctatttgatccagatgatctattgacagtaagacaactttcactatttcatatctttgtcatttgcactatcatcctttccatgttgtcacaagaagttttgatgcatttgttgaattaaactttccttgtgtttgcaggtggcatttgataagataggttccatgacaacaaataccatatcaaagcaaaggaagaagcaagagcctgaagtgatgaaggagctggatcagaggatcagacggctaaattcccttagaatggaggacaaatagcattttgctcttttgtccttttttttacttttttttttttggtggtggggggtggtacgttgctctctctaaatgtcgtcctctgctgcctcgagcagaatgcagaatttatgcattaccttaaattcttatctccctcggggcaggatgtttgtaggtcataaagtgtaaatttggatatggacacatcataaacttattaatttaatgttataatgtgtatcaacatcaaaattcactgctgtggtacttcaatgcccaactcatttttagcctgttcaattacattctcttgcttagtgcctttggaccatgaatttttgaagttctggcaaaactcataattttaattgtttaattattaaaattaagaatgccaagtgcttgtaaaattttgaaacatcaactaatggataatggacttaatattggtaattggttggttgcaagtcgccacttacgtgctttattcaataggtattcttgattcaagggattagtttaattggaatgtttggttaaagatgaaagggaaacatcaacttaaatgcattttcttacacaggaatcatttgcatttgccatttggtaagttcaatgacaagaagaagatcataacgaatatcaaatcgctattgctttaccaaggctgaataggaaattaatgaaatatcaaaatgacgtattacggtgtgtatgaataaatgcgatcacgtggtgtatggttggttgagcatagaaggaaaattgaaaatgttgtgatgggttcatgagttgtaagcggtgaggcggaataactaatttcaaagtatttttaactgataatttttaactaataaatttttagttggattgaagcttgggatgagcaaaaccctgctagagtcactggccaatatcaaagcatgagtcagttttggttttggtttattgcataacagccacaaaacttggaagtgatgacctatttatatatcactatatttattcctagtatttattttcaacatatatagcttaaaaatttgtggcattgttagttgtaattctatttatattgttgatattaatagaattgctatctagccaaagttacagcttggtgtaagcctaatcccccaaccaaaccagcgcaaaggtcaatgataataattttaactaataattctttcttcttttgtatcttgaaatttgaattgtgtattagagtttttaaaattatgttttaacttttattttgctgtttaacgcgtcatgacagctgagctggatttcaaggcggtgccattgcgtccttctttcactagtcatgtactcatgttctggtgcaattcctcccccgcacccccctctcttttttctttcttttttttttttttttttttttttttttttttttactttggggcaatcaaattgcctacttcaaagatgctatgattttttaaattcttgtcttaattatcataacaagtaatgctaaccagtatttcaagtttcaataacaaaaaaaaaaaaacctacttcaataatgctctggttaaagaatgaaaaatgaatcttttattaaaaaaattataatatttaatattaccaacatattaatattatgatttctaataaaacctttttattcattaatttcttaaccaatatatttaaaatattcactagcatgatcataataataataaaaaaaatcatatagtggacttaattactacttttcatctaacgacaacgttgattacaatgatatgaaatgagtttagatgatgacattaatttctgagtgtagtttgctatatatatatatatgttaatttgttatttttttgtttatacgtgagtttccaattattttgttatcagttcttgaaacgtgaatttgtatgttgatgtgtttggaccaaccatctacatcggttcagtacttctgctcaataatgacggacgaagaaagttgcaaagatcaacaaaagggtaaaatatttgtatttttataataatattagataattactgttacagatatatgaagcaagtacaactcttttgacttatttgaatttttatatttttaaatattaaacaccttattaataacattaatttttcttatctttctcttcttatcatattatattatttatgatatcaatatttctctttcttctctctatttctctcaaactgtcaattgattttggatgtttaaagacttttttcctatatgatacttgttcgacatgtgtcaacatttctcatcaacagtgtgtttggaatggttgtaagatgaatcaaaatcaattttgatttgactataaatatgaagcaacaaattgttgctttggaaaaatcttgttttcaggtagttttgagataatcactgtgattttaaaaatatccaaaaacatattatataggagatgtcaatcaaatgatttaagtgaaatggatgaaatgaataactacttgagaagttatctttaataaaaaggtgttacccgaaagaaattgtaatacacaggtcaattttaggcaataaaaagtcgggatagcacttattacataaagaacactagaaacttgccttaattatttgaatgtgtgaataagacttgtaaaagttctaatgaggaaagtaaatcaaatgaaggatagtcgaatcactaaagatgagatcaagaaaaatgataaaataaaacaattcaaagatgtggtcaataatttgtttataaacatgattaacaaaacattacgctacatagttaactccaactagcaagaaaatgctttgctattgttgttgcgttgttttatgcgagtggatgtataattttactattctgctggctatactgacaaccaagttaagaaaagaaaccaagaataaatctgcatttcgaggaaaacaaaaaagttggcatgaagatctccaattgccatagcatcaactacatgtattatacttcaacccgtatctgtatgcacgcattaataataatcttaacaatcagacggaaaataaaacgatgtcttcctcccatattattattgggaaattttgcatgcaattttcatcaaagaatatgcctaagtacaaaaaaattctaaagaatttacaagatccttctattatctgtggtttctcgtaacaataagctttctttcggactgggaaccaagaggttgacatcttccttttgccctataaacaaaaatgtgttttcccccgctcattctccattgagtatggtttgcttcaaccttactaacttaaagaagagctagcattctccgaagttgtatcatcaattgctaaattggatacctcgccaactacatctgtatcgctttcaccatctactgaagctttaggcgatgcttcaggggtgatgttttcttcaggtttcttcaggctccaatacatgatgctagcagttaaaatgagtatcatcttctggttgacctgttaaggttaaatgcataataagctaagagtcacacaaaatttctcagccaaataaatgcaagattagtgaagtatgtgggcaggaagctcaatgaacaaatatatttagataatagaagaaaaatgcttttccatgtacattatttatgtttaataaatgacaaactctccgttatatccaccagatcaattgttaaaacgtaccattccaattttaagatttcagaaacatcatcaatttctaatcctataaaagcatatctattggaaacaaacttcaaccaattaagtccatactccccttttcatagacaattggcataattaccaacaaaattatgtttaacatcgacaaacatacctcaattatgtcctcaggtaacaggaaaatggaacaccctagttttcgggcaacactgattatgtatgttgcattcaacttcttatcctcatctgcaattcatatgacataaatttgaccatttcaattgttgctcataagataacatattctcatcatattaatgtcaattgtcaaatataataatgcgtaatgtgaaattaaagagttgcaagcagaattctagccagcacaatttctcaatagaatgacagagttgacataccagtctcccctttagtaacaagactccagttgacaacccttggctccactgcactcaaaagctcaaggaagaaaacgccaccagaaagattcttatcctgatgaagcacaatacataaatatcaacaatgagttgtagtcatcaaagcaatcatcatgagcactgaaaagtccttttcttcattcaaaagcctaaataaaattacttttagtactattgataacagatgcctgtgatttttctcccaatatgagcagtacaaatatttaagactgataactgttataaataaatgtaaaattaagagtagcaagaactatataagcacacacgcacacacacataactctcaataggtggtttgataccttgaaactatccatttgagaagttcttcctgctcttttcactttattgtttgcccagtttagaatatcagcatcagtaatctctttaccttgtgagtgcgatctcaaatttctcagaagttgaagcatagtaaacctcatcagctgccacaaaaatgctgaggacagagaaaaaacagagatgaatatttcctacatataatggggcatatttttaacaaaataatgacaaataaaaatgttagaatataagagaaatatccaataatatatgtttttgcttttagtcataattttttttctatcgtgttggtccctcattcatctaccaccaaccctaattaacttgggttaaaggtgttgttgatgttgatgttgatgttgatgtgttggtccctcattattctagagtgtgtagttttagtccccaacttaagtgaatcaactatcaagatgatgtggctaacagtgagccaagccataattgccacatggctttattttatccaatatccattgtgttgccacatggctttattttatccaactgcccatcctccatattttacacttcatcttccaattttttttcaactatttcgttcattgaaggatcagaaataaatgttgaatcctatcaatctgataagataatcgatcttcctattggggtggggagaaaggagagacactgagacagtcttgaagaaagttcagatcttgtcctccttttcgaacttgaaattggtggcgtccaccacaaaaaatgaaatggcacccttcttgctgacctcgaagtagaagtttggtggagttaagacttaggttggaactgcattccatacagtaaaaaaaggaggccattgttgtgaagatttctttaagaggactgtttttcatacattgacaagtgagggatttgttcaaagttcacatgcgaagggcaagagggtgggatggagaggcgtggcacaataaaactgatgatgcatcttctatagccacacgagacaaatatatcaatcaacatttaacagaccccaattgatgtcgaggaccaaatgtcatcagtttggaacattgggggaccaaagaaatatgaaaatttgtattattgggaccaaaaaaaaacttgcaaaaatattgaactaaaaacatatttaaaaacctattttcactgtatatctgagtaatttagagtcttagattatctcaattctcaacatttccctatttccttatatttcaagatttgtttccttgtttaattaggaccatgatcattgtattactattttttttttgctgaaagcaaggtatctctatagtcgaaagccatgagactaatcctcagtagcatccagtcattctattattataaataagggttagagctttatgttttgtaccacatatattatatatcttgatttgtataacatgaatatgcaccacagagaatattctgatattcctcggtaataaatctcaagaacatatcctggctattgattatcttcagatggcagatttaactatagtgtagaagcataaaataatgtgttgacccatcaaaatatccaatgaatgaggacaaaacagaatttaaagcagatgttaaatgagagggtaccaaccacacaatcataacaaatttctagcactaacaaatcatcacaaagcagggaaaaaatgaaactcacccaataagagcttcttattcccttgtacaatatcattaccagcaacattcactaatgaaaagtttagttccttcccaatctttataacttggttgcagttctcaactttccgaaatggcatctttataggaggctttgtggccagcttccaattgacagatccaggtgaaaccttgtcaagaacttctaatagaacccatctgcggtaaaggaaaatcataaccagtagttaagatcaaggaaaatttcaaaagaagatgtaacttaaaaacaaaaatgataagaaaatggaagacacagatgatgagccaactgaacagtggaaaacttacccatttctgacatcctcaaaaacattattgacataagtggcaattccaagactgttaatccatagtctaaagcatcgttcttcccgagatgtctctgcatcatcagtcatcatctcagcaaaggacattttctggctgtcaactgttgtaaggccattcctacaaaagtacaagtaacagagatttttggatatatataaatgaaactcacaatctaaatcagctcaagatccaccctgtactgtatacatttctaacttaataactttcactaaccctacttacttgtacctaacaaatgaatcaaaccagtgagatccattacttattagtcattactcagaggcctatttaaggataatcataacaaataaaatgcataagcttaagtggcaatgttatatgatataggagccacacctatccaaattcatagaagggcagaaaacagcatgggttcttggaagcatatcccaaaagattcttattgttatattgtatgaatttacaatgaaataattagcacatttgcaatcccttaaaaagaaccatacctatgctggaaaatttgagcaacaaatgcaagattaagattaggtgacccctccactatgtcctttggagtaaggtatctcttgcaatctaatttctctgcctgctcaagaaccatgtttgccctttctgttggatcacttgtggttagggcagatggacctgccacttctggggcaagagcattaagcaagtaagcataagcctctccatcctgcgaaaagaagattattgtagatataatagactcatgcaacttagaattatactatatctcttaacaaatgccatgcacataaaaaactagccacacaacttatttttttttttgatcggccaatgttagttgttaaatgttagtttttttgttagtggagggattcgaacccacgacctctccctccttcccttccttcccttcttttccttttaccacccaaccaacctttttgttagtggagggattcgaatacacaatgattcagcaattggcatgatgtagggaaatatagtgaatcttttcctttgaaacttgtagatggttgtcaaggccagcagaatataacaagaagatccacagtttctttactgatttaaaaggcacaaaaatcaaggcagtggtgtgtataataaaaggttgttaataaggaatactggataatatttcatccatgtccagaattatttctattagagtaagtcagcatacaaagttagtaagaatttccctcacctttaggtcagaagagaagtttgtaacttgtttctcatatccagctttcttcaagtggaaattcatccatttcagtaagagcttatcaggtgctaaactgataagctcctccacatcctgccagcatgttaaatataatatagaggtttatttcaatcacgtttctgacatatgtaaaggaaagaaaaccattgtacatgtaaattacaaataagaggaataatattatccaatatcaccttgtcatcttccactaattccacaagttgaggagttttcttcagattgagatcagctaacaattgaatctaatgttgccaccataataaaaagttaaacaaacaaaaaagacagcaaaagtttacatgtcttaccaatgaaaatggtgtcaacttcctcatctgagttccatattaagcaagaaaagggggggaagtttccgtagtttaccttgattacttgcgaaatcaaaccaagtaccagatggggctacaaataaccaaacaggaaaattttcaaaaatgagttaaagtcggtcaaataaaaaaaaaaaaaaggaaactggaaacatggagaggggaaaaacaaggattgaacctactcttccttcaattaaatcctgtgtaccaatattaaccaccgtgcacccaatagccttggccgaattgaggccaagggtatggttctcattcctttcccatggattaagaaccttttttgtgttaatagctcgatcatctatggtcccaggaacagcaatattaataagcttgctgcagcaataaaataaacaacaaagtcagggaggaaaaaggggagacaatattttttaattagctgatattgagtcctgaacatctaccaaagaaggactccatcttttgcaagatcaaacaatgcatttgttgatggatcaattggaagaaactgactcatgaatttatcttcagccaagtagttgttaatatgtgcaacataagaagctttctcagattcattaattgcatgatgaacagttgttgtagctgccttcaggaatgaagaagaactttttgaaccaccatctttagctattgctcgggattgaagattcaaatgtgcctgccatccaatgtcactgaataagttgctaggtccaatataaatataattaatacctacaaaagtactcacaaatcgcggtttcatgttaggtgcatatatatgtgaagagtccaggcaatatgaacatcaaatgacattgtagtgtatattttccaataatttctttgagaaagcaataaacagaccattctaaatacatacagtaaaagttaaattaagaaacacatgaacacataggaggaattcagaaaccatgccttaacttctcagggggtaaaataaaaataaaaaaacaaaaactcaccctaaggaaggactcaaaatcaatctcttcatccatgttctgatatgactctgccaaggcatccttaatctcatcctcggtgaacagttcagagaaacccttcaatttcttaaaaataggtggcaaatttccgacagtaacacgtcccgattgagtcctttccgacacatactagaaagaacgtaacaaacatacacaatgcgtgttctgagtccgagattgtggtgtcgaagagaaaaaaaaaacatcagaagagaggaagaaagaaacataccttggatttgagggttcgaagttcgacttgggtgaactggctctgaagccattgatcagaaacaaggacaccgacgaaactagacatgttcgactcggttggagaaaaacaacaaacactcggaacaacacacggaaatcaaatgtttataagccaatagagataacacatttgttttgaaatcaaatcaacgatgcgtgaatatttaaattacaccgatccaacagtagattgcgacaaggctggcacgaagcgattgagaaaggagtattgagaaaacgtccctaagaaagtcagaaaaggagagcgagatcaaaaggattcgtcattgtatttgcgtggagcttcttcttcttcttcagagagagagagagagagagagagagaggcttgtgttatttgattgtgcgaaagaggaaatggggtggagagaaaaaaacgaaaggacccgcgaagaaagggaatgcaacgcaaatactatcgaatcaaacggtaccaatacaatgcttttctttctttcactcgttagactctctaatgatacttttaagttatttctataaattttgtttttttttagttatgaagttaatttttcattaagacttagtcaaagttcataatctctatataaaagtgtattttatgaaaatcaaattcaaattttttcttataaatttatcgtatattatcaattaagatacatcaattaaatttttgttctatgctattgcaagtgccaattgctaattgctaaatgatatatatatatatatatatatatatatatatatatatatatattaaacaagaatgacatgtggcatcaattcagaatccccacactcctctttccttcgctttcgtattgtttttatctattttgttgctttttcacaagccaaaaaatatctcatcgccttctacaattttttcgtcgttattatataaaattatatatatgtaatgttcttgatctcgtgctatattttaccataaagtaaggttcggttcaagggcaatccaatgaattcatttaaaaaaaattccgaactcagactcagtaacgacatttatttccgctttcctttatatacatccatacctaaccttcgcacgtttatctttaagatgaagatatttaagtatctgtttatccaaaaacaataaaaagaaagttcattttcatcgcaatcaaaccaaatacaagatttaaagaaaataacaattttaattcttatctaagaaaatcctattaatcttcttatttattagataaaaaactattgaatactttctaagttttcaagatattaaatacatttattttttatttcatataatttataaaataataagaatttttatatggaagatttgcaagacaatgtcacattaaattataagttattatgcatgtattattaattaataatctagttaattagtgttcttataatattggtggaattaaaaggaaaaaacatttagtataaaaattatagtaaaacacaaaaatattatgaataacataattttttattttttaataaaaatatttttactttatgttcattaatggtatgtttttatataaatgtgaaccatcatttccaaaactttcttatttttaaatgtcatgttgaatatgaagcatgttatacttagacgacgaagatagttaaaaagttaaaattgcacacaaatagaacggtgtgcatcataaaaaggaaggtcaactcttttctaaatgaaatatagccaacctcgtgagagctctaggtccattcatgtatggtccaatcccttaactatcacatgcaaccgctttgacatttactctagttgacctttaatatctatctaactgacattaaaaacaccttttattttcaaatgttacttcaatgttaagtttttcacacgaagttgtacaagtatttaacttctttactagtcacttatactattaatttgtctaatatataagatggattagatgcttgggatgacactgaacgaaattgaattctgattaatgttagccaagatggacttttgagtggactacaatttgagattttaagcgatgtgtcttctagcatggacgagatttttagtgaaaaatggtaggttcctgcaaaaagatattacaacagttaagttataaaggttcctccaaagagacacaatatgtattaaatatttagttgttaagaatataaggacatatccaaatcacacatatatgatttctcatcatgcacacgtttaagacaaatctcatcaatggttagttgcaagaaagcattgagaacagagtacattactcaatctcatgaataaaactttcattaaatgaacaacagttcaattacaaagtaagatttaatatttttggtccttaaacttttaaaaaaaattgtttttaagtctctaaacatttttttaataatatttttggtctctatattttttctctaataacatatttagtcccttcttgtgattttgctagtagtctagtgtctcccacacaggctagcatcagggaccctggaacgctatcgatgttcaacatttttttgcaattagagttcgaggagttggtcaagcgtctaggatgttaactggcatttgggaattgatatactagtgaatagtgatgctagaacagtgcatcgtttaaccttttcagcatttttaaacaccaaaaatttgttttcttacacgattaaagttgaaaacattattagaaattcttgattccaaaacaaagacaatgtattgttatttttatacaaaagttaacaaaactacttaaaactcaatatttacaaaaaaaaattttggtgcaaactcaaattctactagtttctatctatttttctaagatttcaatatttattttgcttttttctcttatttttttccttcaaaatcatgcacataaatttatcggctatatttataaaaatacttcctaacaaatcaaatagggacttattaacaaaacaaaagcaaaccataacagataaaataaatctcaacaaaaagaaagcagacttaatttttttaaaatatattgataaaaaagccatcatggtttaggttatgttgagttgaaaggagagaaatagtgtagatagaaataaaaaagaaaagtaaaaatatgtaagaaataaagttgtttgattaaaaagaaatatgaaagagataaagagatgagtaaaaataggtaaaataataataaaaatgaatctcattatttttaaaattatttctcactttatagtccctatcaaaccaaaaacactaatttctcaaaattgtttcattgttggaaatggacaccacattaatacttgaaatcctattcatgatttgaaggacataataataactttgtttatttttttatcaataaatattaatttgttagttttttcaaaaatgtcagtttgaggattcgaatccgagatatgtccccccttccttcattattcttcaaccgttggactaaccttatatattcttaacttagtttttttttttttttttttatttacaaactaatcaaacaaggagttgttcatttttttttgtaatcatgataattagaaaaaaaaatcattttgttagaatccccaggcatttcacaaactttgagattttgagtatgatataagactaattttcgatccgagacttaattacaagctcatcatcactccttcccaaaaaagtattatgtggaaattgatccatgatcttccccactaaactataccaatttgataataatcttgtttattattattttttaattacaaaaatgtcactttcatttgaataaattttattattttccctaggtccgatccctctgaaacaaatacttctgaaataatcttgtttttactttactcagcttctggcctggagtccaactggaacagtaaaggtccaaactccaaaccccatttgcatttgactgatagatgcatccagttctccaaaaagaataaaacagtgagcattagcaagcaaagaaaagatgggaggagaccggaagaccaactttggctaattttataggcatccataataaccctttaatattaatgctttgatgcagtggcgtttgtgcaaccctcttaagagttaaggcatacgtaaagagcaaaggaatatatacacttcaaaattaactcagcaaaaagccagatttaattccatctcaagaagcgtatcattgaaaaaagctcaacgcataacataaagctatagcctttcatgaatcatgatcaaccttaattaccataatgctatagattttaatgatcaatcttagataccataaaaaccttaatatacacttctgtctccactataactgttattggaattgtgcctgcctgagtgaaactgtactgattaggtgaaacaaagtcgtctagctcatacttgaaccaattttcaattatctttgtagttattttgaaaacgacattgcaaagatttgttggccaaaattactttagcaactcacaattatcaacatttctttttcgtcgaggaagtatcaatcaaatacagtaggctttataaacccaacagagcaaggtagcattggaaattgacttcaagacttcaacaccgtgcgagttttacttacaaggaccaaaaaactttttgtaaatattagagtttgaattatgaaatcgctaggcacccaaaaagctgtcaaagacccaaaaaaaaaatgttaataatacttacaagatctggattgaaaaaaatatatccttgattatttttttttcaaaacggcatctcctttcacatgccactaggataggaaaaataccgggtcttcaggagctggaacgttaaaaggtccaatataaaatcagcatctttaatttaatttcagctaccgtaaaaagagcttgtaaatcatttgatttccggaaacatccctttagagaataaaatcaactttcggaatagactttaactttaagtgacggcattaaaactctcaaaaaaaggtagataaagtcataacatgacaaccacataacatgacatccgcatgctatgagatttaacaaaaaaatagtataatagaagaaatcacattcatacatacattgaataacacttatgttcaaaaaaatggattcaaatcaaagcaagtggcaccaaatgtagatacataaacataatctaaattaaatattcaattggaagagtgccatcagaagagcaccagcacaccaaaagttgccaagacaaggttggcccagattccatagctgatgagcttgtgagaaggggagccatcatgagtggatgatggagatgatgctttgctatctgcactgtgttcagttggagaatcagcagcaggggcaatatcaggagttggtgcaggagcaggtgcaggaggaatatcagtgccaaaaatggcctcagggagtagcaccttgtcaacttgatatattgcaacaggatctgtggcatgaacagcactgctcaccctggtcttggaccatcctgaactaatgtgcaccgtcccagaattatcagtgaaattcaaagtgtaatcccctccggcaaatgtgggagtagagctggtttggctaaggcttgtgaactccgccagagaatagaaatgtggcaaggcatggaagaggatcacttgctttagctggttagaggtgaggttggatagggtagttttctttacagcattgaatgcactgtccttaggaacaaagatggtaattccttcttcagtgttgttggcttggttttggaaagtgtcaatcactttagtggactcaaggtatccaaggaaggtgtgaaatggaccagcaacactgagtaactcagttaggttcacgaagtccggtgccggggctggtgctggagttgggctcagagagggaggactagcagttttggcaaatgctgaactgaaaagcagcataatgttgctaacaatgaaaatcatagaaaactccatatcttccttggccactggtttatcctaccttgctatatcaacagtctctccaaattcctgtatgaaaagagctccacagtggttagatctcatcataacaaaacctaccaacctgtgaaaaagttaaataatgcgggaataaaaaatgaactcccagttcaaactcaatctccaataaataaaaaatcataaacccctcaatttttttttttttacctaaccttctttacatctcagtaaaaagttgtcaacatcttactaataatagactaacataatggctggaaccagatcttacaaaagttaacatagaggaacaaaagaaaaataataagatattcaacagaatatgaaatgcacaaggtaagatctatgaatgcgaattgaaccagagcaagcagaaggaaatgcagatccgagtatgatatgaacactataacaatttgatagaagcgaataacacttaaaatgtactacttttgcttcacactactgaaaaatgttaaattcagaactcccagaagactaaatttccaaatgctaaattcgagatcagacagacacctaatgaaatgaatgttgaaagattttctattttcttttttgaaactatcaatcatccccccccccccaaccagtgccaatggaatgaatccattactagttcattttcctcacaaagtttctaacttgttgtcaaacccaagccaaacgtaggtgagttagacttagaccagtcaagtacacagtgacagaattcacataatttcatgaaccccataatgaaatgagacagatctagactagctgatccaaaatcacaagcacccatgagacaaaaatgacattcaaatgtgaaaaggcaagaaaagctaaaagtttgcacctaaccataaattgagtgacattcagaacaaaagtaaattaaaggaaaggaaagatattgagatagaagagcacacagacatgaataagaggaattcagagagagagaaggagaatgtgaaggacgaggaatgagaatggaaggagggtatataaagatagaatggagggtacgtataccagctggaagggtattagtattggctacagctacagcaaagagatgcttctaacttgagggtggttctttggtgaagacatattatactttaatggaaaatgcttctctggaacacacttttttctctccttgtatggtggcctttccatatccgctttaactaaattacttctttaacccatcatagaccaaccttgcactctaccccaccattttccatctccccattttatcatctagctaaccgacatacataaatggtttctacttcatttctagtttatttattttcatcaccaaaaatgaagctgacgtttagccctccataccaatgcggcaatgctaatatccgaccatgctgttcacatgccccaaaacctacaatggaaaagtattttttttctaaattaaattatcgtttaattcttgaaattgtgtaactctatgtcgttaacttttttaacgttaaaagattaatttgatattaatttatattttttaagaatcaatttaacattaaattatataataatacataattattatattttttacatatttaatttattcttttgaaaactaaattgtcattaatttatatatctagggagcaaaataatcatttacctttgatatgaactattaagtgcacatgactacaatcaaagatgtggtgactagcatgaaataaaataaacttgttttctctatataaaaaatgcacggagcttccataactatatgaaaaatgaatgtgagatcaagttttttgataatctcttccttgcatttctctttaactctttaagtcctcaaactatattgtttcacaataattaattttttttgtgtcaccatggaacacatgaattaactggtgaggtttgtttcaatttaataaaaaacctcaagttaaagttttaaatatgaaattacggaagagttttgtcatttataatgatattattcaactcaaataaaattactttttgtaagatatatgtgatgtaggaaaaaaattgtgttaagtttaactaactaaattttgttccataatattaaattaaaacttattatgcttatggttaaagttcattactcataatttccgtataccatatgtatataattacggacattatggatgctgggcaaaatcatattgaataatcttttgtaggttgtcaattcaagacttgtaataggcttagtgctcaagatttattaaattgattgattaggcttgtgtaaccatcaaggcatatataggaccacgttttgattttccaagacactaacctgtctagaaaatcatcattagatgcaattctaacggactgtagcaatgtttccctataaaaaaatggactgtaataatgttagaaaaaattatgtattcaagtttaatcagcaaatgtaacaaaagtggttagaaaacggtaactaccgatggataaggcgagtactgctagcctaaaaaataagacatcggtcataagagaccaacattatggtgttaaaacgagttaaatccaataatttgacttatataataagttcaaataggttgagttcgactgggattttcgtaactcgtataacccaacccatttaatccatcaatcttttaaattacatttaacatttatatttttttatgattattggttaattatttatttgatttactagtttaataacatgtttttttaattatatttgaaaatcaaatttggaaaaaagttaagacaaataaaataatttatttatttaattttattttttaaaagagttgatggtccaacctaacccatcaagaaaaacttaatacaattttggtcttcttacttagtttcaatttctcgttttttacatcttgcgccctcataattttaagtattcccaaattacccttcttttttctcttaaaccttatttcctgcacattcgactttaaacccccattatatctcacccttcattcccttcttgtgtcttcctccttcttgtacttttttttatcagatctaatttgcggatttgttaatctgtaatataactttttttctcttatgaatttgcttatccggaattttagtagcccaataaaatagattatttttccatttttcattggttgaaaagcccggcccacatacttcaaattacattcaaaactcaagcaaccggactagcacaaagattattgtgtcccaaatttagattggcaaaagtaatgcagctaagaagagatataaaaactaaagaagttgacaactagggaacttttattgggaaagttacaaaagagtcctctttgcctctgtctattttagtcaataccaaaaaaaaaaaattttagtacaaacatgaatttagtacctaacatatatctgaatttctcaagtcaatacaatagaaatttgacaaaatgaataagaattactattgcagatgcaaattgggtatattgccatcttcgttcaagcccattccttcctaatatcaaaagtatagttaatctccaagtagcatttgttgtcatcatcaagaaactgcaaaaagaaaaaatatgatagtatatggttgtatcattaattcattatcatacaacaatagaagaaaatacaaatgttattctatcccatagtatgcagtgaagcaccgcttcaaattttactactatgatgatatgcaatatatactattaagaacaacacaagaagttggtgaccaacaaacctcgattccactactgaccgtaatccatttacaaggaaactaacaccagaatatattaaattaaagccagacaatatggtacttctaataaagaaacattacaaaaaatgaggaaataatgaaagaagtaaatggaaaattatggaagtgataaactgaaatgacaaaaccatgataaacttcgaataaaatgattgagaaccctttgaatcaagtatagtagtgattaaagggacgaatgaataataggtagccccacaccccaggcagatagtgagccgtcgtgactattttatgcaacatttaagaggaatatatataatccaattatgaacctgtgtgtgtgagtgcatgtgtatatttgtacaatcaagttcaacgtatttagaagtaatattacctttgatcttgcagaatatgatcctcttgcaaatagcccagagggagtggtttcttctggcatctcatgtgtgtaaggctctgcctgagggctgaaagttcctagcatctcttttgagctatccactgaaattagaattgttgtaagagagtgcttgatcaagtttttcatgtttataagtttaattaatttgaaatagatttggcacaaaaaaaaaaacttacctttgacaccagtcttccaaacagtattggtgtatttcaagccagacacaatattattgctcacatggaaggtgaatttcaagcggtaatgactaccttctttaagagtaaaccataaaccctttggattcccattttcaggaatggaaagaacaatgtcatctctatcaggagagatgatagacaaacaagtaatattcacttcagggtccagaatttctggaaataaaaagattaacgtaataattgatacaggtttagaaaaaaagaacatataaaagaaataaaagaaatcttctgattattgttcacaaaacaaaaatcccaactactagttttgaagttttaatggattatagtgaatattatgatttctcaaactgttaattacatgaacagaaaatgccaatttgcatgttcctcatgttaatcttcctgtagttgcataagtcaacacttacatttattattattattattattattattattaattaaacagtaataactaataacatagccttatattaattttagaaataaaatataatgtaaatttgaatattataagctttcatgcttgcgcaatagtccgaccaacttgaacagaataagtcaaatgtctaatgtgttctgattcttctgaatacaataaaaaaagaatgcttataattaagggaaaaattaattaagtgatatataaacctgcagcattgttcacatccacacttccaaggagttgttccttccatcttcttaaactctcatcatcctatattaatcccaaaattcaaccaaaaaaagaaatggaaagaaaattaatcaataaggaatgaagcatgaaacatgacctgacgataaatttcagcagacacagagaaacaaaccttatctttctcaaggtgctctttaagagtgcactgaggacccaattgtaatttggatccaacttcatcctcctcatcttcagttgcatagatagaggactcactcacgtgcctgctcaagggctcgccttcacttttataatgttcttcatttgcatgatcacttttctctccagtttctttgttttcatcgaaccccatcttcttggaacttgaaacagctccaacagggaaggtggttaactcatcaaccgtcacagggaacaacaataatatgaccaaaaaatcccaacaaacaaacaaatggaatataattaagcaacgaagactaagtaaggcaacaatgggtaaaaataatgttttgaagggattagtgaaactgaaaaaaaaaacaataatagtttgtgtctcacaaaacctaacaacgaccaataaccagaagcaaaaaaaggcaagggatgtcaaaggaaaaatggcttgtttgtcttgttggcaatgttttaggaagagacataaatttatggctaattttcggaaatggtcatgtggtgatccgaaatctttgtaaatgttactgacatcatgacatggttatatatattgactcatctgataaggagaccaaaaatgttttggtgaattttcatttcaattttgtaaattttaggattaaaaaattatatatcttactatttactgacaaataagcatcactttgaaaatataatctttttaactaagatgatatacatgagtcaatgaaaaatacagtaaaaaaaatgctcttaaaatatttttgtaaatcttctttttatctttttatttttatcgaaatcacttgtgttgctatttattgtatgttaagagtatatttttattcaaataatatataaaataaatattaagagagaaaaatcatgatcaaacatttattttttattttcaagtctatttttcttatatgaaaaatataaattcaaaaataatataaaaataataaacaggaatatataatactatgtaattaattgttaaaaaattatttcatttattgttgatatgatgttaatatgtaattttcaaatgtatttattatcaaaattaaaatttattttaaatttgttgacatagtataatttttattttatatatatatatatagttaattgttttaaaataatatttttaatgattttaaagatattaattttaattatgtgatattaatgaagatttcaattgattaaattaatcgcatcataaattgaatcatatcaatgattgttgaagttaaagtttcgatctgatgatgtaaaaatattgaaataaagactatataactgaattagattaacaatcatcattatgagttaaaattttgattctactactctcaaagtttcaattgaagtttagttatgtatgtatgtagatagatgaacctaatagctagtgtaatagggatattttgagaaggtgagaggaaatatggatattttgagaatataaaagaaaagagtggagagagtaaagagcaaaaagagggtgtcaatatcatgggcatttccacgcaagatagcagacagcccactaaactacattcaaaatttatcaaaggtatcatatgaaatgagacctaaaagtacttgtgtcaccgattctcatatactctatcataaaaagtatagatgataatttcattaaaattatttacttgtggagcataaaagtaaaaggttacttacgggccttattttgctaataaaataaacattggatttttttttttgtttcattttttgttactctcggattgcaaaaatgcagtcatgatgtcagcaacatattaagaaagatggtattgttgcctagtgttttttactaaggcattatttgcaccttttcaaacctcggacaaacacattttgcaagaattttttttgtctgtttccagatttacagctaccagagttactgttatgtgtgtggttgttaggtaaataattccaatgtgaatggtgatgtgatacacaaattgttattcttaggcctcatcattctattttggagttggaggcaaacaatgatcggcaattctgtgctgtgggttaaggtcttaaggattcttgttacgaatgttatgcttaagatctcgaatttaggacataaatgtaaataattttttttaatttaataaagttcgggtagttctcatttttatatgttgattgttagtttgatggaattgaattagatgttaattctaaattcaaatatatatatatatatatatataattttttcccttaacatataatatataaatgtactcttagtttttaatgtttttatttattatatatatgtgcaaaaattcatcaattttgtttatgattaatttttatgtgagaaaattttttagtgagatatttttttcaataatttttttatatatatttataggattcaattctaagattttatttaaaaaatcaaaacttagttcaatttggacaaacataatgtttttaggctttcaatataataacttaataacttaattcatatttttataatttaaactgtgttaaaagataattggcaatttattataattacaatgttgagatccttgtgggaatgcatgggaaatcggagaatggataataagaaacaaaattagcttaagaatgaagataaatgaggatggggagcagagagacacactctattcccttcccacgcgagtgccatgccatcacaattgtataaatagtagtgtgtgacaaaactttacccgttggcaaatagcacacacaacatttcaatggcggcatgattatgcatctattttgattttgccattatagtctcattctcgtaatcacatcagaatcaaaaagagaaagcagccacaaaaccactactacgtggtaggtgtaatctgaatgggcccagatatgaatatccttgcagggcccactatgggtccaatggcccaccagccgacaaggcccagatagatagtttaggttttcgtcagggtctgatctggactactacctgctaccgtacggtttcttcttcattaatttatttgtttgtttgtttgtttgggatcgatgaaagatttcattccaatgcacacccaaaaaataaaaatataaaattattgctaacctataaatttacagtttacactttacagcgatgctaaaatatttacaatttatatatattcataatgttaataaaataatttataataaatatctggtaagtcgtagttattttcagattggaaacctagaatcgtgatttgaattaaagataagtttttattcaaactatgattataatttaagacttcccaaactaaaattattttaaacctctcaattttgaatacaaggttatcactccattgacttaggctcaaggatcgaccctaacataatgaaattggatcctctcttgctcctattgtctctccagcacaaaaaataaaattagaagctcaaaaagaatgaagagaggaaaataaatgatgaaaaagtaaatagaaagtagagagatagaaagactagacggaactagagagaggatattggcaggagaagatccacataataatctaatactcccatctcacatatgtaaatttaattttcatagctaataatgattatattatattcgaaaagatatttcaattaatttttatatgtttttattgattgaaaaaattgtttaactgtttagtaaataagttttttaataactttttaataatttttagtatttattgagttgttatttgaagtagcattttttaaatcctaacttttaactttttttatatttttattctcttccatatatttatctaatttcctattacattttcaaataaataattatttttatttttatgttattttatacatttgagttacttcaatagttagttttaccaaattcttataaattcttataaataaaaagtgtaaaataacaataaacaataaaatcatttttttttcaaatgtaactaagaaatttgatatatatatatatatatatatatatatatatatattaaggataaaaatgaaagaaaatataaaaaactaaaaattagaagataacattttaaaaaatgctacttcaagcaatctttcaaaaaatgctagaagctactaagtttaattattggataatccaataaattttttagctaataattttttttttagaaatgagttgaaatgttctatcgaccatatctttaataagttaacatttcagttatcaactttaagcttttgactaaattttcaaataattttattgaacataatcaataattaaatgattattatcatttccttacaattattataattcttgttcatttattttttaaaagcataatagttttttgttacgaatattatgacgcttttgatttcaccagtttgtgaatatgatggtacataataaatattttattataagtgaaagttacaaattgatatccaatcaaatctttctatacatgatttgtactactttcgtatgaattttttctgccattaatttttttagtaattttttaaagatattcattcatgttgtcatcttgtcgcccttataataattgttatcaattgaaaaagttatgacaagtaactttgtgcaaataagaatttagtcttcaattataataagagatcaatcttattatattggatatcagataagtatttggcctagtcgaatattcaaaaatatatttgataaaacttttatagtacattgaagtatatcctctagaagtgttaggtattcaaccatattgaatatcgagacattgttgtttccatgttattcaaagattgttatattcatgattgctacccaatcactattagtatcctagccttcaaaggttgttttctgttcatggcgtgccaagtattcggccatgttgaatacccaaacacttttgttaccctgattcccaaaggttactttctctactcatatcactgtgaagtattcggccatgctgaataatcaggtactgtatcacacactatttctataggacaatatgcgagtattcgacatgattgaacacagaacactctcacctcaccttatttaaaggtaagactatctaaattagctaataaacaagcattattgaaaaattcaactctttaatgataattaaagatacattagctaaaaaggtaatattgagaaacggtacataggttcaagccccactaaagtgtgtataaatagttacatgaatattgaggtataggtaaaattactgttaagtcttatttattactcataattattgttatcaaccaagacctcttacttgaactttaaagtgtcttttgtaaataccctatcatttggattgccgaacattatttgaagaagaaaggagatcatctaggagaattacacaagaagaaaaattatctatctacccgttataatttgagtatcctgtcattaaatttctcaaagatgaatttgagttgtacataagaaatgtactacagtattatttactgttaaattagcttaaagaaccgtttgttttaaggacattgcactttttattattttacaactaaatcatgattgaataaccatgcattgaatttggtaaatccccctgtaaatccgactgcacaaagcacagaatgttagaaccaaaagaatgatgatctcaatgctccattattcagcctcccagtagaggagatctgaaataaccattataaaataataatataacctcatctctaagcctttgtcaccattattgccaaacatgcttattaacattcagtgaaggatgcgtcaaatcccaagattcttgaagtgtccccacctctccgtttctctgatcaacttgaggcctttacctctttataaaccactcttaatgctcatttcttttcatcaaaagcttttagctttctatatcactctcaactttgcttcttttcaatcagttacattttctttggtattccaatggccactgtagaggtaactctactaaaatacttgctactctagttcacatggtagctcagttcagaacccgcaaataaattcccttatgttaattttaatttggcatcaatttcttttattttcagtttgatctcaaccatatacttgcttcgttttttttttttttttaatatatatcatcatacccttcaccgaccctaattaatttggattaaaggtgctgttgatgttgatgatattgatgatcatacccttgcttctgtgttatcttagacaggaagttattcatttctttagcttcaatactccaaccgtcattttttttcctgaaattcttgtcacctaattaattaaattcagtaaaatgacagcaggcacttggcatcttatcaatatatatatatatatagctttgtcaaaaagagttcatatacttgttttcctcagaaaattatatagaaatgtacaaagtagctgaatgcaaatttcaattagtttgtcatcagacagagaagccacacgaatcatatgccttttccatcagtcatatttgttagagtattaaaagacgtattaaatctatattaatctgacagctttgaaactttatccttatataatatatattgcaacaactatgagaagtgatacattaaccaatagttacaaagtaaagaagagtaagaagtgtttaaattaaactgcatgtccaccaccttattaagtttttatctcagcagagttcaagttggaattctaataaacaaaatatgaattttcatctgaatatgtctttgtctgttggaattcgaaattgtaggttgtgtcagcaaagtttgccctccctgaggacacaaaagaggcatcattgaaggctgatgaggagaagaacacagaagaagtttttgagactccaacaccagcaccaacaccagaaactgtcgtcactgagcaaaccaaggaggaaagtactgaggccccacaacctgcagcttcagaagacaagccctcggttgaagttgtgcctgaaactgtcacagaagagccaacagttgagaagacagaagaggaaactttgaagcaagaagctgctgtggaagcaaaagaaaatgctgatcctgctgaggttaagacaccagaagctgcagaagtagtgatagaaacacagaaagaagatgttgctaaggaagagaaagaagctgaggctgaagctaaggaagaggctaacacagaagccccggcagagaaaagtgaggaggtgaaagaagggtcagctgaaaagaaagacgaagaagtgattgcagaagcagaagctgagaagagtgaggaggtcacagtcacaggcacagaggctccaactgagaagactgagtaaagaatgtgaagaggggaaatgtgcagtttatgtgactgttttagttgcatcatgccataatgtgttgttgctccatgtcttttcttttctttgattagtgatctaataaaatgtctagctaggaatgagtgatgacccacttaagtttacgaatgccaaccatcagtacaaggaccacatggcatgtactatttcgatctgtttatgtactgtgagctctgatccaatgaattgaagtatgttatggtccttattgtgtgattctgcatgcagggtaactttctttgttcaaataaatatgtagattatttatatgatttgttcacgtcacttagtaactttgtgttccatgtcgttggccacctgcccgtactaaaaattggaatgaacctcggtcgcgggcatcatagtccatatagatatatgaatcaggttaagaagatacatccaatataatgaggtgcatctaatactggtttgcgagttttaccataaaactagatatggatctgttgtactggcgctttaaattattttcctgtaaatgtctctttcatagtagtaatggaatgcataaatgcgagattaaaagtagaggtaacaactactacttagtgactgccacttagggataaaaataaagcaggctgcaaagtgcaagtagatctccatcgattattatgacatgagggaaacatatgtaccttcacacaacattcaatgtaagatcaagacatgcaagtccttctcacatatatatgtttaatttatttttatctaatatgaatccgtctaatagtgaagagtttgaataattcacataatatgttagagatttaaattttattgttatcattgtacgcttaaaaaaatagtaaaaatagtatgaggcttcttcactctaacttactactcaaacacatttaggattaatttatttaaaagcatgttttgtaaccttagagcaaatttttttttcttaagcatatttttataggacaaccaaacatgactaattttactctcaaacatatttttggaactctcctaaccaaaattcaaacatattcaaacaagaggacttttaaatatgttgtatgtagggcctactgtcttttagacaacatatttataatgttatttacaccttcctttttgttcttcacagcttctctttttgtcattttcccaaaatacccttttttcttatcttcacaacttcacttttttttaatagattttacagaaattaattttcataataaaagtatgttctagtatatgattatagtttccaaaaatatttttttataataaattacaaatattattttggattcaggttcaatgcgttattgtatccctgtggatatttccctttctaaccatacagttgctagtagtctcactgtaattcccaataggggcgagcatgcaaagagcaaaataagagtagaaatagcatgagcctgccttgctttatctctttaaactgtatgggctgaggtgagtttagagtagtggcccaggaaaataacaatatcccttgctaagaatcttagaattaaaacataataaactaacaattattcttatcatacgggtattttttttaatttaaataaaactttaaaatgtggaattaaaaatttataaaaaaatgtatacaattaatttaaataaataaaaatgcaagtaatttttttcgataaaaaatacaaaatgcaagttatttattcttagcaaaaaaatcaattttaaatattattttaaagttaaataactgattgtttttaggtgtcttaacttcagtaactggtatttgaatattggatatgttcttccccatatatatgaacatgcaatttgagccagttgtctgtctctgtcatccaaaagctgaagcggatagagttgagttgagtttagtgctgtgctgtgttgtgtgcgtctttaatctatatagaatttggctttgtgagagaaaaatggtatcttaatttgttttggaactcagcaatggtaagaggaagagatgaaatgtatgtggcagcaatgcctcgaagggctacaaagggaccaccccagtaagctccctcagtttctgggatttccagcatttcatggtaacttatgttgataaaaatggcaagagtaacataataatataatatatgagatggatcgtaacataataacataatatgcaaacgcttagttcagatttgttttgtcaccgataaagtattgatgggtaacttatgttgataaaaatggcaagagttaaagagaccgttgagacaaaaatgagagatggattttgaaattggtttaattactttttttgtctatttttttctttcaatttagccctttattattaaaagattcaattagatcctttgaaataaattatcatgatattgatgcatcatatattcaataattttttttaagaagagtcttaactataagtactcaatcaagtagatcattttttttttcagtaaaaaaaaaatctaaatatattacaccttagttctaagatattctagtaaaatatattagtcaattataaggtaatccgtgagatattcaagtatcaaattctaagagtacaagtaaaagtcatttttctttgaaccccggccaaatcactcaagaaagaagaaaacttatagtcaatatcctcgatttccattattaaaggtgagaagatttatgagaattgttttcaatttgagtttaatttttatatatagttagtaccaaatattttacactggcaatcaattaaaaattataataaatataattttaaaataattattataaaaattatcaagcgtatcatataattaacttataattaaataatagtataaaagattacatgaactaatttctctgttagtttatcttaatggatgaagagctatacaacaacacaaaagtctaaataggcgagctatagggatatagtttagaaaaattaaagagtcagctcagctgctgactttccagtccttcaaatgcatttttaaagaattgatttgaaaattggatgtgacaaataagcattgccaacttagagaaattatagatgatcatcctatgcttatgaacacctagtgaaaaaaataaaagtgaaaaaagtataagttttatagataatgtggggagaaatgagaaatatttgttagatgaataaaaaacattgaacattcatgtatcatcactcgtaaacttgatagaaagggcttgttgaatatacaaagcatagatattaactcattctcacaaatattaatcgttatcgtaattagatggtgatttttttttctttctattttgtgtgaagtatcgtctgctatctaactttacacactagcttttcaatcctaaactatatgcatggaaaatactgcaattcttacgcaaacttttccatatggccaacaagataaaaatagtcaattctattttaggaggcgcacaccatacacacacgtgtgtgtatacatatagtggcggatttaggattctggatcagtgaggacaatttatttaaaaataaaaattgataactatcattattatatgagatagttggattcaaacacgaagataagaggaataaaatatgaagttttaagataaatatttgcattttattaaaataaaatggtacatttatttactcttacgtgtgaacgggtaaggaggttcaaataaataaaattaaggggttcaaaatataaaattatgaggtgcaaaatatgattatttttttgcattttattaaaataagatgatgtatttacttactcttatatgtaaactgataaagaggtttaaatacataaaattaaggatgtaaaatataaaattatgggatttaaaatataatattttaagacaaatactagtgatttattgaaatgagaagatgcatctgcccaccctcaaatgtatgtaggtccgctgtgtatatatatatatatatattttatatatatatatatatatatatatatatataattgattcttttaagataattgcagtcaacaatcgcgtcctgaaatgatcatgcagcagttttgaagaatgcagcctacccactattttataaagtttgtcatcaattattttatttcctggtgtgatatagagtaggtcgaaatttgcttaagtgatcaataatcaccatgtcctgttaataaaaaacaaactactatttagagagataaaaaaaacaaaaatcacggtattttttgttgaaagctaaaagccaaaaatattatgttttcaaacgtctgaagcaaaattttcgtaatgaaaaaccatgcctgtgactaaaaaaagtgacaacaaacattccggattaaaaaaaatagcaaacaaatcccccctccgtcagaaaaaaagagaaagagtcaaagaataatgttgaaatggcttctttattcaataaaaaaagaaaaaaaatatatgatatggatatccattatattatttaacacaagagaaaaaaaattatataataaaactattgatatcacaagaaaaaaaaaagacaaaagtaaataaaaagattagatatatatttagaataatgagatgtttatatattgttattaaaaaataatataatgggtcggtagaggcataatccacctaacctccaattccattgtcaaagttggtatgcccaaatagctggaattgtaattggaatttgaatagaatacattacatgaagcaatgttgttgttgttgtataaaaaggggctttgtccatccatcaaccgcattaacagtaatacaataatacttattacttttccatactttgagaagctacgtacttacaatggctgctgctattgaaatccccacaatggtgtttccaaactcctcttcccaacagagggtgccagtggttggaatggggtctgcccctgacttcacatgcaagaaagacacaaaggaggctatcattgaggccgtgaaacagggttacagacactttgacactgctgctgcttatggctctgaacaggctctcggtgaagctctcaaagaagctatcgaccttggtctcgtctcccgccaagacctcttcgtcacctccaagctttgggtcactgataatcaacctcatcttgttgtctcagcattgcgcaaatcactcaagtgagcaacttcatttaagcacaattttttttttttttttttaccgataaatgttacttgttagtttattagtttttttattagtggagctgagattcgaagttcgaacccacgcctctcccccctttccttctttcttcaccactaaatcaaccttctaattccccacttgtaaagatttatatacaacttatgtttaacttataactctgtctgattcattttacttcaaatatatatatatcaatgcttttacttacatcaatttttgtcgtgcagaactcttcaacttgagtacttggacctgtatctcatccactggcccctgagttctcagccagggaagttctcatttccaattgaagtagaagatctcttgccttttgacgtgaagggtgtgtgggaagccatggaagagtgccagaaacttggcctcaccaaagccattggagtcagcaacttctctgtcaagaagcttcagaatctgctctctgttgctaccatccgccctgtggtcgatcaagtaagtctctctctctctctttttccgtgtgttgtattttgttttgtttatgggaatgattaatgataagattaattactactgttacaggtggagatgaaccttgcatggcaacagaagaagctaagagagttctgcaaagaaaatgggatagtgataactgcgttctctccactgaggaaaggtgcgagcaggggcccaaatgaagtgatggagaatgatgtgctgaaagagattgcagaggctcatggcaaatccatagctcaggtttgtctgagatggctgtatgaacaaggtgtgacattcgtgccaaagagctacgataaggggaggatgaaccaaaatttgcagatatttgattgggcattgacagaagaagatcatcacaaaatagatgaaatatatcagagccgtttaatcagtggacccaccaagccccaactcaatgatctttgggatgatgaaatataattaaactcctaaactactactactactacctcaaatgtttcatttgcctcggtttgcattttataattcatggcttcatgttcctttacattacaccttaatgagctttcttctagcaagtaataaaatgtgagaccatacaatacaacaattatagatttgtgaggtaacaataaggcactagtgaggttttttttttttttttttttaattcgtgagaataaaagacattgttactagatttataatatctcacacacttttatttaactaatcgctggacttttctcttccttgatttttctcttccttgatagaaagtatttattgtatattaagtatatttttattcaaataaatattaagaattaaacgaaggaactctaaaaactaaatcatatccttagtaaattgtgtgattttaattctattattacacaattatcattctattactatttaaatattttaacaataaactattataattggttgatattttcgtaattgtgaaaattaagaatataaaataatcaagaattagagatacaaacttgaaaaatataataattttttttccataatccgatgatccaaaccattcccaactttaataggattggaaaaacaaagtttcaaaacccaaatcaaagcaacgcaatccaatatgcatcattattttgtattcaatctcaccctaaacctaaattaattcaacccgtgaatattcctacaaaaatgagcacgaagaatttgaaatttgaaattctacagttttaggtaattaaaatacttccacaaattactagaatttcaaatattttttaaatataatatccaaacaacatattttaattataaaattctctcttacgttgaattgctcatttaaattttcttatccaaacataccataaaatttacaattttgactgttctaaaataaagaaaagcaaagtaaacaattttaccaattaatgagtaatgtttcaacacatgcaaaatttgttatacatgtatatataatattaattattgattttctcattaattaccaaaactactcattttatcttcttacatgaattgctcattttaaataaactaaactcaaaattatttatattattttctaaaataagttactcaatttaaataaaccgtatctgaaagtttaatgatgatcagttcttcttaaaaagaaagtgaaagatatacttaaggtaagtctctggatcttagacagatttatgttttcaaaccatagatatggttttgatttttattttgggtatattttgacccgaaatgtctacatgcactgaacttttatgggttcactcaatcagtaaaacgtaagtccataggtcttattagatagctttatgttttcaaaccatggatatggatgtgcttttaatttttattttaggtatatgttgacccgaaatgtatacttttcacgggttgactcaattactagaacagtatattaatttggataaatattagagacaacttatattttattttaatataatagacttaaaagcgcacattcaagtgtaggtgtctttgagattaattatcgcatcggaaaaaaatattttttttatataaatttataataacatatagattttttttaaaataacataaatacaatttttttcataaaacataacatatataacaaaaaaagtattctgaaaacataatgaatacagtttttgacaatcaatcaccttcaatgaattttattaaattttacaaaattatctatgcactagcatgttgatattaagttttaaaataacatataaatcctacttttaattttatttgcaaataaataattttaaattttatttcacaattatgtcaaaatattttttctcctaatatatttaaatatatgtattttaattttaaaattaaatacctctattaagtgtaaaaatagatatatactgtatattttataaatatacatataaaaatgaaatttataaataatataatattaagaaaagaagaaaggtaaataaataaatttatttataagtagacatgtatgagttagttgggttaagtagtaagaaaaggttaaagagtgtcacatcaaaatatcaccatcaacaccaccacgagtccacgacgttatgcaagaaaccaactaccacgatcatgagttgacttgggctacaatgaatgttataaaatccggtttagctctgttggtcgggtccaactaatcagaatctaataacctaacttgatcagttttactattgaatgttcatgcatttaagtcaggataacccgaccaaatcagacccattttgaaaaaatctggcaatccgactgattctacaaacccggaccgggttatgcaaaaaaaaaaaaaaaaaaatggaccatccacgccaccatcttccccgacttcgacgcttcccacctcttcaacctccacccctccgatgccacccgcctcaccctcttccccgccgatctcctcgacgccgccgccctctcctgctccatctccgcctgctccggcgtcttccacgtggcctccccctgcaccctcaaggaccccacagaccccctaagagaccttctcgaacccgtggttcagggcaccctgaacgtcccaaagcggcggttggcatgcgaagatggtggcgatggcgctgatcatggaggcggcgaggaaggagaagccgaactcagcggagttttggaagaggatcatgacgacgtcgcccttgtggattccgaggttggacaatccagcggcaattttgcgggaaataaggtgcgtctcggcgtagtgaaggttttggcggcgggtccaacgatgaggcatgggcggtcggcgaattcagagacgttctcgaagcagtagacgtggagagggaggtggttggagattggtatatctagtaattttgatttgaagacatggctagtttgggaatcacaaactttgttttgatcagtttttggggtagacacctctttggcatcaagagaaggagctacagttatcatggtgtcatatataattttaatttttttaatatatatcaaataaaattagagtaattattagtttacttattggatcattgatacaataatttattatcttgacctaatcaataatggaactgaatttcataatacttactatacttatcacatgatttttcaagtttgactttagttaatgttatttgaatacatgttatattagtatggtgtattatgagtaatgtaagataatatattagaaccagctcccattttttaattgtgtatttaacatgaaagataggatcaaactaattttacatgggatgattttattcaaataggataaaattatacgtgtgacaaaattctttcttttaaatatataacataacctatcattaattaagttaaaataattatgagttgatccacaattttggtaattacatttgaaggtttaaataaataaacatagcctaccaagaagaagggttgactatttcatcctcagaaatagtaattaatagtatagtttggctttgttgtctttgcctccttaacagatgatgagtcatgagtgacagatacgccgccggactggacttggagttttgttttgattccttctcacatggatggcactcacttgacctgttcagtccaagatttttcgttgaaaggcatgggctaagagctagctcacaaccacgataaatcattaatcatagcccaaaaaattaaacgctttaatttcaataaaagacaatttttcaacagcttaaaaagaagtttgagcgaagttttttaaataatgggtcttgttaataagtatttttaaaatattaattaagatattaaaaaaataaattatttattatataaattataagataacgtaaaaaagattttagatatcataatttttattttttgataaaaatatttttactttaaattttttaatcaatatatttaaaatactgattaacatttttcttaaataatagagatttcagggagctattattttatctcgtccattattattggagttaatcttagtcagctatcatgatgttaaccttctgtccatttatacatagctcattttaaggattctacttttccatctaatattattgtcatcatgtttatgtgcagctggatttattgcttagtttcagatatgtaagttttattctaaacgaattaatggagtcatgcaaattattcaaaattttgaaacgggtgtcttttgtgtcttttattatcatttcactggcagcggtcccttatttgttactacatagctagaaaatcaaaacttttcaaaaaaaacgaaaagatgattgaataagtcagaggaacatatgttattcatctatcaaagaattaattaaaatgaaagctcattatagcaaaatttgtttaccctgcctaatactttcctatccactgaaatggcaaatctaaagagtcgacgcattatatttacaggaataaaaaaaattaaataataagagtatgttttaacctataaaaatattattataataactttcaatttttttatctttttccttcctcacatcacatgtgtcgaaacaatgttgctcatgcatatagcaacaaatggctaatcaattgttgggaaaacaaatctttcggacatgaaacccaagttggtaacgaaaccttttttgtcaagtagttttcacctgtaatttgcccgcggtcaacaagaaacgtaaggaattaagaaaatgatagacatccatccgaatttgcatgtccaaaaaaagagtcaaataattatgtagaaaaggcttctctagagtccaattattttcaaaataatcaaatacgaacattttagtatgaggatccgtgataaatattttttataaattaaattttataataaatacgtccgtactactatatatgtagtatactttaggtttacaatgaataatttaaattctgaatctgatataagaattttttttaattattaatattttttaaaaatttattaaaatgcaattaagacttgaaagagataagcatgaaagattcggccaagaaaagttcacggatcagttgacgacttgacgtacgtacttgatgacaaaggttaaagtttatattattatatgttaagcgagtttcaacaaccaagaaggtgtcgtaggggaaaaaatattacatgattgaaaatagggtgtgaatttggatatgtaaatggagatgttggcggggacggtcatatatgaaatcttgcatatgaaagatttttcccccatggggatggggatcagataaatattctctcgtgactacggtgggggatgggatcacacctccgttttaagaaaattaaataattatttttatattaattattattttatattttaaataataaaatattaaagattgattttatattttacttgtattagaatttaaaattaatgttttaaattgttggtgaaactttttgagtattttttaaatttacttgtattaaaatttaaagttaatattttttaaaagttcagattcttcgaggactgtgaagatctatagagacggagacaggaaaaaaaaatctccaagatggagatcggggatgggatgggagtagggagtattccccgtccctaccctgtttcgttgagatccctaattgaaaactattataatttcaaataatcattacatatagttaaatattattaatttgccaataaaatgagaaacaaattcttttatatctcataatataagacatccttaagttcatatgtattgaaataatttatttagcgagagaatctgtatttaattatgtattttatatgttcataatttgattttcaaaatagtgtaaagtgttttgaatcagattcggacctattcttcatctcatgtgtaaaatttctttggatcatcaagagtcatgcatagcaaataaaattagtttttaacttaataaattaggaaaaatttgtgatacctaacccaagaaaaaatatatatctcttaatgatataaatttgatttcgattacccatatacaaattttgttagtaaaaaatctaaaaaatatttgtataaatattcatttaaccttaagatcgaaccctaataaatctcatataccaactcacctcaacttttaatgataattttaagtgtgtcccagagaaattgattaaaacaacaagcgatgctccgaaagtatctaatgagccacctcgatctcatctgaccaagcttcctggttagtacctttgaattgaataatataaaaaaagaacatgatggatgggggtagagctcagtataacccacctacctccaattgctgacttttcaaagctagactgcccaaacccaaacaattggaattacatgaagaaatgttgcactataaaaaggggtgcccttcagctatgtccatcaacaaatattggaatactactcttgcattgcatactacactatacttgttaaccctttgagagttacaatggctgctgctattgaaatccccacaatagtgtttccaaactcctcttcccaacagagggtgccagtggttggaatgggatctgcccctgacttcacatgcaagaaagacacaaaggaggctatcattgaggccgtgaaacagggttacagacactttgacactgctgctgcttatggctctgaacaggctctcggtgaagctctcaaggaagctatcgatcttggcctcgtctcccgccaagacctctttgtcacttccaagctttgggtcaccgaaaatcatcctcatcttgtcgtcccagctttgcgcaaatcacttaagtgagcattttttcacacaaaaactagttataattcataattaaacttcttttatgagtttgtgcatctttgattttacctttgataattaattctaagtaaaaaattaattttaaatatgattttacatgtttaatattccgttagagaaaagttcaaaattgattatgaattaagcaattttaagtaatatttgcattagatccaaaaatttcgctaaatttaactcctaatttgattttataataaaaatatttgaacataaatcatatcatttcaaaatcaatttcattcaaaattttgtcaacgtttcaaacaagtttattctgacttctataaatgctctcttgtaaaagtttatatacatatataacttaattatatgctataactctgtctgattcattttacttcaaatatgtatatcaatgcttttacttaacatcaatttttgtcgtgcagaactcttcaactagagtacttggacctgtatctcatccactggcccctgagttctcagccagggaagttctcatttccaattgaagtagaagatctcttgccttttgacgtgaagggtgtgtgggaagccatggaagagtgccagaaacttggcctcaccaaagccattggagtcagcaacttctctgtcaagaagcttcagaatcttctctctgttgctaccatccgtcctgtggtcgatcaagtaagtctctctctctctctctctctctctctctctctctctctctgtatgttgtactttgttttgtttatgggaatgattaatgataagattaattaatactgttacaggtagagatgaaccttgcatggcaacagaagaagctaagagagttctgcaaagaaaatgggatagtgataactgcgttctctccactgaggaaaggtgcgagcaggggcccaaatgaagtgatggagaatgatgtgctgaaggagattgcagaggctcatgggaaatccatagcccaggttagtctgagatggttgtacgaacaaggtgtgacatttgtgccaaagagctacgataaggagaggatgaaccagaatctgcagatctttgactgggcattgacagaagaagatcatcagaaaataagtcaaatcagccagagccgtttgatcagcggacccaccaaaccccaactcagtgatctctgggatgatgaaatataaactatttactatgcagctcggagtctatttttataatccatgtttctttctttttaccaacccagctctgtctacttgtttgatttgaggtttaaataattgatgcgatgtcacttcttattttagtatttcgcaccacttcttttccccttttactcaagcccacctgcattgactatttattaatgacccatctttcgtcttcgatttgacgaggttattacttacaccttgaaaagaacactataaatcatcaaatttaatgaagcatatcatgcaaggattgcaatctaaatctagcctaactaacagaatcgtacgtcgcgtgtttgtagctccaataagccaaactgtaccacatacaaggaataaactagggacgtgctgcacatgatatgaataacctatgtttcatttttttcttaatacttctatttatgtgaagaaaagaattttgacaaatattaaattccgttgaaaaataaattaaatatgataaaaatttattttcgtaaaaaatcaaatcaaaatattattcaaacgatttaatttcaatttcaatatattaatcacttatttaacccatttgtaattttatcttaagaaagtttgattacagtgacaaatacttgggaagtcaaatttcttttaaccaattaaaagtaaataattactactagatgatagtgaaacatgattttacactaacattaagttaaatttatattaatctaattatacaatctatacactttcctgcaagtttctgtggtaaaggcccagtcttcaaattttgcgataaggtatgaccaattattaaaaggagtggttgatcagctctactatttctagtgtcgttttatcaataaaaaattcagtcaatcttgtttgttaagaatcggctacaccatttacaccatatatattagtatttgtttttaaaattcaacatattaagctatatgttttcttaaatacattctcttaattggtgaaattaaacagaaaaaactagtaaaagggcgagtgaaagagattgccaacgaaattaatgacaagttataaaaataaaaatcatgtaaattccacatatatgtttttagagttttatactcacgcacgtgccttcgtttccttgtttctttttatctagctaccacaaaaagccatgactactctggatcacctttagatagtctattatggaccacatttaataatcgttagattcatctcaggtttatattgataccatgcattttacacactagatccattctttcctccctctacagtccctctttgtcgtatatgttactggagaaggcgatttccagcgcagcagcgacgattttcttttttatttttaaaatcaacttcttccttttcttcctagattcaccggaatcctcatctctctgcatagttcttgcaaactttcctttctcaagagaggttaatggaaaccattgagtattaacaaacaacttggaatattgcggtcaagagtggctctgatcactgcatacaaacttatagaaacaatttgaggattgaaaacaatttctcacactttcttggccggaatcctcatctccgctgtccacgagattcgcaacatgcggtgcttgtggcggcacaccaaaacctccttccagtggctcctttgcttcttccttgcatctgagaaaaagttccaggcacggggcgtagatttacttccaactctagttccactgcgtgttgcggatctcggtggcagcaaagatgaggaaggtgacgccggcgcacggcggagaaggtctgcagagggatcggaggtgagaacaaatctagtgtgcaacatacatggtatcaatataaatcttagatgacctaacaagaaaacctaacttcaagcattttaagtttgagaactgttctcagcttctaatcgtgacaataataaacaccaactacataatcatagttattaataattgagttataaaattaatatcaatcatttatgaataattatatgattaaaaattatcattttatcatttttatgataataagtaaaaataatttccatttaatatgtccatataatataaacaattagatgattttttttttcattcaacatttaatacataactcaaatctttcagcattcattttctttttgtgacatcttgatcttttttttctccctaaaagaataaacaaaaataacaaaattacaaaaacgaacgaaatgaataaaatagaaatttacaatcagaaatataatataaaaacaaaaataacaatacaaaaaattcaaaaaaacaattaatgttatgtctccctccatccctatttagaaaatcattttaactaatttgcatcccttaaaaaataattaatttaataaatcatattaaatctgtaaattaattatattatcattctaaaattatcttttcttatctctctatttgcttaattatttctcgtttatatttaaagaaaataatcaaataaaaatatgtaaaaaaattaatatatccaaaaattacaaatatatataatcttataaaaaaagataaatgaatttaaaaaagaatattagaaattaaagaccagatataatatatatctccaaatcccattctctccttagagttttctacttgttctccaaatttcacagttttgtaggcaccatatccctgagtcacctaatcattcttaaccttacccctccacgtgacacctattgccttgtccgtggtctctgcgtgagaacaaattggctcagcaccattacaccaccaccgaagccaagggatatattttgaagtaaatggtgtttcaaggagctatcattttaacaacttgtccatttattattggacaatattcagtgagtgagctatatatcatattaaccctctgtagactgacttgagacttccacgaattgattcgcatatgatatgaacttggacagtgttaaagttcagaatgaatacccataacaaataatagaaacgtacaataattaatcattaaaattttaataaggtacaacatattaagagatttaactcaattaattattaatatttatctttaattcttatatattaaaacaataatgttcataatattgcctcaagtctcaactcaattcaatatctcatgttctttttgaagatatacttttttcaacatttatgaattagtgataaaactttacttaataaataatatgatataacattatactatacttatatatatatatatataaataaataaatcataaaatatatttaataagatttaacaatacataacttaattgtatattttatgacttaattatcatcatgttacaaatttttcttttttacaaattttatcattcaagtttttaattttatgtattttagtattcaagtttgtttttcgtatattttaccatttaaattttttatttttatgtattttattattatattaataacaaaacgacattatttttaaaaaaattgatctttttagtgacatcatcatttacaaactatacaaattaaaaaaattcagtgaataaaataataaaaattgaatgataaaatatgcaaataatcccaatgttgcccaatatattatcaagcttcaatcaggtcaaaattatatactacaactaattgatcctcaaattcaaaccgaacaaagacaaagataatcgctgaatataaaaaaaaatgacaagattagccaataccacaaacgcccctaatgtaatgtaatttgtaatgcattatggtataattttataattcaagatagcgaacaatactcgaccatatttgacttgtgtcaagattttcctttaaaagtggcacgcaagttgaaatttagaatatccaattcccaatttattcaatttcaaaactcagttcccttttatcaagtaatgtagaaattcagttaactacaacaacaacaaatccttatcccatacttatcaggcaaaattaatgaatgttttttagcggcatctcatacttttcatacaagaccaagatacaaaaaaaaaaaaaaaaaataacagccacaaatctcacgaatcatatgcagatctaaatcctgccttgcaaacaaatagaagttctattctatttgacttcgtatgacagtaaatggtagattgtggaattacgtagcaatctctgagagatagctggtaaaaagatacactgcatcctgcaagtgaacagagcgttggtcttctggaatgggagcactgaaagaagtgtcaaagcagttaaactgctcatcacgggtagcaccatcacctacacctgatagtagcaaatcacatatctcgcctgccattcttgaatacaccaccctgcaaaatcagtaataaccgtgaatatggcaaatgaaacttctctaaacgggtgacccatcacatagtaaatatggccaactaatgaaataacatgtcaaaaacatacaggtgcttaaattattgggataaagacgtgtggttttgatgtagtaaacaaactgcaaaaccagattcaataacactagcaactaaactaatatattactgtattatcaaattttctttgcctctttataagtccgctgccagataaaaaatggttttggataagtatattagcaggcctataaaatcagaaatcgagctgcacaacctaaaaacaggtcaacaagaagttactgcaaaggacaacacataccttgcatcaacaggtaatctgcaaccccaaacagctagggattcatttagctgactgacaaaatcctgacaagcagcatttttactttcaagagaatcctgaaacaagaaattacatgattttaattgatcaatcaaatggaaaaaggagtattcccttaatctctaacaattgaaatcacaacgaagagtatccactctactgatctagcaaacaaacactgcaactgttacctagcttcataaatcatatttttaagtctattaaaagattatctcatggaaagattgcaccagctagaagcatttcaaataattgggtaacaggcattattgtcttttgcaccactgcatgtgtgtgtggttgtgcccccaaaatatcatcatattttgtgataaatttgtaacatgacaattccatgtttcaagcaggatcaaacttgtttaatatttagttacacttcacaatcatactatgacaggatcaagtaacaaccatttttcacataaatgatgatatgagggatgatcctcttctataaattcacgtaccaattcagtcatagcattggtatcatccggaagtgagtttctcatcaaataaaatgaaatataaatatcagctcccaactcccagttttcaatttcagatttatggtcctccatggaagttgctatcctccatatctcagcgtgttttgctgccaaagatattaaataagttatctatgatgcacttatctggaattaagaagaaaaaatctagtaattttcttctattgaaaagaaataagttgtgataaaatgactttcagcaatttaaagtaatgatgatacaggacaaaatggggtgtgggggggtcaacaatattttattgaattttcatgtagttgttgaagagtttttcttttgtgatttactgggttattttagattatttcatcgtaattatgatgaaattaaggccctgttaggatactatatgaataatgaaggttcttgaagatttttttataaatgtccataaaagagcaagcttgcatgagagacgcaggtattttctggcaaatattattcggtactccaacgttttccttattttttggttttccatagttatgactttggcaaatattattcggtactccaacgttttccttattttttggttttccatagttatgactttggcaaatattattcggtactccaaggtgttttttaccaagcaatatacacacacgacttaccttgcaagaataacctatgagcaactgaagttataaaaatagcatgagctttctgccaatttgcacactgaagaaattgctcaagggcttttgagtgatccccattataattataataaattgcctgcaccgccacaacaaaatcattcaaacaacaataagagtcatttaaagaaaaatacaaaactttgcaacatttcaagcattaatatagcccattaatcagtaaagaacaccaggacaacaatttaattcagttttagacataaattgatcataatgtgtgcccatatgaatctaataagcggtttttgtccttaaaaaaaaacaaatctcataggttttataactcaagcaaattgaaaaaaaatcatttatataaactgaattaatagtataatcagaatatacagtgtgcttgtatttttttttcttttttcattaatggaacaagagggatgtactagaaagtaaagggaagggaatggaacaaagctatcattatgcttatttggaagattaatataggaacagatagaactccgataccctttgagttccccccactccaccctaattttaggggacaaaatttgtgatatggaggggaaatgatggggaatggtcccctgatgttctgttccactccaatctgtttttaaactcccacaaacaagggaacttattgtccttcccctgattccctctccattcctctcattatctatcatccaaacatagtatgagagaaagatgaagttaaaagggtactgcaacaaattatgaatgccattgatatttttctttttacaaaaaaatgaataaaaaattaaaaaatatgatgcataccaaagcctcatgcatccaatctgtgggaatgcctaaatcctcaatgaactgttgctgagattcatctgaactccaagtttcacagtattggaacaatatttcccgaatcagatttacatgaagatatggataatcttcacgaaggggcaagtgaaggaccacatatagggcccaatgacatttccctacacacaaaagctgagacacaaatgacatatctagaatatgaagatcattagaattgataacacccacagcttccaagactgctcgttgatgccaaatcatatgataatcaagtggatcaggggtagaagagaatgcactaaacatagccttcagaaagctgaattttgtctctttgctggcatgaagaagcattaaataaaatgaaatgtcaaagtggttatccgtgttccaactgataacctcctctgatgttccttcatcaataaaaaggggaataggatatggagctgttccctcatcaacaaaatgtttataagtctgaaaagcaatggctaatgaagtgtttggtggtaatttgtaccacattaataaacctaagaacctcctccagtcaattttgatgtcatgcaatgcatcatgaatatttcctgcaagcaattcatagagtctcaatctgtccttttcaatgaaactaaaatccagccctttatttctccaaatatcaagttgccttgcaatatcagagcgattcacagtagaaccaccagcctgacttaacaaactagccaacctcacatctcctttggacaaagccagctgcactgcttcatctagttgccgcccagtcaggagtacaaatatatgctgcagataatcagaatcatttagagagcttatttgattttgaacatgataggaaacactctctcgcaaccaataactaaactctgccctcctcattagagggagtgcttctcggtcaacatcttgataaatttcctttaaatcctgcatcatatcttcctcattgtcagcacccaaagattctacttgacctttttgttctctgtcagaaaaaagaactctaattaactcccaggtcattacttggtgtgtcaaacccaaacgagtagtggaagataacccaggaacactcaattgccgctcaataagatcacaatagtgatgagaaatctcagatagagtcgaacgattagcttcaagcttttgaagtgtcaacttgcagggaccaatttcaacttctttcatcacatggtttattcctttgtgaaaatttaatggagataccaaagcatgatcaacaagttcctcggtcacttttttattttcatccctaaccacattgtcgaaagaaactttctccaaattgacaacagatgataacagtttgtgattaccactgcttcctacgggtgcaccggagtgtacaagaatgccatttggtccccacccaactcgaaatgacttacccataaacagaccagcatcaactatattgtgggcatagtttccagatactggagtttcatgtttgagatctagcttaaaaccttgtgattttatcgtcctaagaggcatgcccttatgctgctgaaccatcaaaatgcctccaggagaatttgaatcaaaattcccatgtttatactcaagtaatggaaatggagtttttctagcaactggtggggtggatcgatggttgattgcctgagttgaactttgtaaaggccgcacatactgcttaccagaagatgatttgcagcttaagtcctctatctcttcttcatcaggaaacatcaataatctcatttctctcattttaacaggatcaagcctaagatgagaaggaagagaatgagaaagttcaagttcattggtatttgatggtgattctttctcaacatcatatacctcagcatcatccataacaaagtcttcctcatcatcatcaccaaacccaaacctgctgaagtgtccaactaagaatttccactcaccagtcactagatcaaaggaaataaatcgtgcttcctgcctctttgtaatttgttttaatttgctaactataacatcttccttcccctccttagacttcaatatttcactgtctaataccaaaactacttcagctgccttgttaaggccctggccaacagcaggcttatcattttcatcactgtatacaactatctcatgcctatgaaacttcacaatttcatctatacgtaaccccctgacatcagtttcattgagatacctgacatatccataaccaaatcttccaacagtgaaatcaggaacacggctgcaataaccaggttcaacaagctccctggccactaattccttcaaagatggtttggtgtaataaccggacgagttcaagataggtagggaagcttcagtttctgtcatgatatcaatggatggatgaaaacagcctttataaacccttcttctcttgcaagtgtgcaaaatgcatgaatcagagacacctccaacgtcacattccatcacaaagctaggtcaaagtgaagcgttgcgttctgcacattgaaatttgaccgcaattccttgatgtagtctctaaaacagaaaaataaaaataaaaaataagcgcatatgccagcaaggggaactggatgttgcatcttatcgcatggaaacaccacgaaacaagcaaatgataggaatatacaggtttcaatttacctcttaggttaacttaaaataaaacgatagaagataaaagaaaagaaaatatgcaatatagctagactacacaacagaggtatttatttataatgaataaatatgagtttgagaatatgaaaactaaagatgatttgattaagcagttatacagatcaagcttactgaaagtgcggcatagcatgtagaagcgtagaaataaaacgaaaagaaaaaccaaatacatagagttaagtagcgtcttagtgcgtaaaaaagaagaacaaaagaaatgaagtaggctgaagttggaatacttaagatgaactcacatcaaaggtggagcagcaagcaacgacgctggagcgagcgaggacggtgagagtgagactgtgagagacggagtggtttagcgggatttgggaaggacaactgaagttgggccgagttttaatactacaacaaagacgggcaaatctacaatgggtatttagtatttacactttccatattgttatttctactccccattggcttctttttttttcttaaaatatatattactaagaagtaagaatatatcttttttatttatttataaaaggtataaactctatttttgaaatatttctgaaagttaatggttaagaatagatataatcaataatatatcatcccaaaacaaatgaattcttcaataatcttgggcctgtcttaaatgatagggattgcttctatgttcactgtcccgaaaagtagaggtatctgtttgaggttcttcaaacgacaatccaaacacacgattaatctcttcgtcaaacacatctttacaacatgtagatatttcaaaacaagctctgaatatttaaatagtacatactaagtactacatttgatctttagatataattgttcatgtgtccttacaaatagaattaccccggacataaagacatgttgggctgtattgggccaaggcccatgaattcccccgctaaagggagggttcttcttcttcttcatatttttcttttttccttaaaaccctcttctctgcttgctgcttgctgctgctgcctcttttggttgagttgcgtcgtctctctaacaaaacaaacaaaataaaaatgatttctgcgatttcgtgggtgcccaaaggggtttcgaagtcggaacttgtcgtggctgaacctcctcccgaagaagaaattcaagggataatcgccaaccacgcaaccaaaaggtggtccttttgtttggttccaacaaaaattatcattcaccagtaaaaccctaacatccaatttttttttatgtgcagtggagacagtgacaatgaagacgctaacaacgatgaagttgtggcacaagcattaaccgtagcagatgcagtcggcaaggccacctctggaacctgtgacgaaataacccttgcgttgaaggaccttgatatggaccgttatgatgacgaagatgaaggtacgtaattctgcattctatatgatcattcattgcttgtacttatatgtatgcaatgcagcagctgcttaaacttacgtttgtcatttgtttaggaattgaggtgttcagttctggaattggtgatctttattatcccagtaacgacatggatccctatctcaaagataaaagcgtaagttccagctcttgttgtcattttattagcgttgcggttgcggcgcgtgtcttcttattatcttacgttgtttatgatgcttcaggatgatgattctgaagaactcgaagacatgatcattaacccaactgattctgtcgttgtttatgcatgtaccgaggatgaagtcagttatcttgaggttagtgagttagttgttttgtgacttgtcaagtcctcgtatattatacagatatatacttatcactcctttctttctgcaatgccaggtttgggttatcgaggatgccgattctagtgaaatgaacgtgtatcctcaccataatatcattattccagcatttccactctgcacagcttggctcgattgcccccttaaaggaggagaaagaggttctttgcacgatacctcttgcgtgtgtatttgtgttgatcgagttgcttgattgtttgttttgtgcaattcgacttttctccctccccagcactcaccatttaattgaattgaagggcgctcctagaaaagtgaaaaataacaagtctgaaggaaaacttgtaaactgtctttaattatatcctctgattatttctgccttcattttagtatgccaaaaatgaaaaatatgaacaattcatatatcatccaaaggtgaagtggaaaaattgtaatggaaagttgcatttcattagaaaataaagtgagattagtatatgctgttcacttctgttgtgtagaccattaaaaaaattcttcaaagtttgagtaactgtctaggtttggactacctgaaatcaccaccattgcaatttgtgtttaaaattttacttgatacctacttgatatatctttgctttatcttattagcttaaaataattttattatgatcacagggaacttcatagctgttggttcaatggaaccttccatagaaatttgggaccttgatgttgtaagtggtttgagtatataaattttaactgtgttgtctgaaatttcatatacaaaaagagagatctttttttctgaataccttgtaattttcctttgctctcagattgatgaggtgcagccatgtgtggttttgggtggatttgaagagaaaaagaaaaaggggaaaaaggtttgttctacatttttgttaatttcaatccccttagaatcatgtgattacctcaaaatggcagcatacttaattatgatttatttgtggaaattgcatatgttgtgctgtttgtaaggtttgtttgtgctctttgaaaatttaaatgcagttaagttgcaaattattgttgataattcaagtattattgtacatgtgcaggtatatatatgcatgtgcacttaaattgatacccttagcttagctttttacttatgaaacttaatcattcatgtatatccatgtacatttttgtccattgttagcattctgactcaataaaatgatagaaacctagtatatcttgttagaaaaaaaatagggaaaatctcccctggttacagcactgcagaactttgatggtgtgcacctcccaatgccaaaaggccctaatttcctctcacaatggcaggatgccttcctttgctctcttcagttgtacatgtgaattcacttcaatgatcgtagctaactaactactaatatatgggttagttgatctcttactacaaaagatagtgaaaatctcccctggttagttactgcattgcagaacttcgagggtccgtgataagcgtaagccacccatcactagggtgtatacttgcaagcagcgagtaatagaagcaacagttctggaccacccaagcagtgctgaccacccaacagacacgatccatccaaggggcgcaaggtcaagcgatgcgaatcaaggggacatgacctttggtgatcacccaacagacacgatccacccaagggacgcaaggtcaagagatgtgaatcaaggggacatgaccattggtgaagagacacaccctttgggaccaggaagtgtgactcagaagggtgcaaccggtggagaaagagtgcaacccttggagccaaaacaacatcagatctggagcagttacaaatgagaacagtcacaaccatttctgaacaattgtgtctattaggaatagatgttagatgcagtataaatagaagtaaaccagattaggaaggggaggaaaaaacaaagaaggatcagtctgaattgtggagaagcaggctctcgaaaacctgtgttattagaaaatatctcaatttacttatataaaatttctattttatcttttctattctacaccatcttctctgttcttatcagtccgcaccacccaatgccaaaaggccctagtttcctctcacaaatggcaccctttcctctcatctgttctaagtgatacccttcactgattgcaactaactaataaataactactaaccaactaattaaactaactgatggcttagctaacaaaactcaactaactaatggtttatctaacataattgagtatatcttttggtcttttctgaattttgtaacttttttatttgggattgtgaatagctttagatgaaaccgaaattgcagatgtcttatgcatatgagcattgaagctactagtgtgaaaatccatatttttgcttgtactattttattagactttcatctttatttttttttaatacttatagatttttgaagtaaatatgtttggccatttcttattaaaattattttcttgcagaaatcaatcaaatacaaagatgacagtcacactgactcagtcctgggtcttgcttggaacaaggagtacaggtttgttgaattaaaactggattctgcttttattttctctgttggatgtgctttctggaacctaaaagtttatcttgacttttattttcttaaaaaaaggaacatactagcaagtgctagtgctgataagcaagtgaagatttgggatgtagttgctgggaagtgtgatattacaatggagcatcactcggacaaggcaagaaattagctagagcataatttattttttatcatgaggtcaattcattttattgatgaaaccaacttttttctcttcatgttgacacacttccttagaattattatataatttagaactttggagatatgatttaaaacatcaaatagattgaggtgatttttgctgcactattatgaaccaagatggaacagttatgtaattaatcatttaatcttcagctttgaattaaatgctttattcaatctatatgtatgtgagaaacgaatttacaagtctttcttgggtctttgttgagcaatgctccacatttttttataatggaaaaagtttctccttctttggttgaatgatttgacgcaatgtttttttttttttttttttttttttttaattttctgtttctactttaaaatatttgagtcaatacatttcctgatgtctttcagatttatctcttgtccatctattctcacaggttcaagcagttgcttggaatcttcatgcaccacaggttcttcttagtggttcatttgatcatactgtcgtcttggtaatgatctgatccaatattcctttgttactcggcttttctgtattttgctgtcattgattacttattatgccgtacactttggttgtatattgatgtgctaaaagaggcattcaaattaaaaaaattgtttattttttgtttaaaaattcatatagttatctaatatttatagcttttacactttgcagaaggatggaaggatgccatcacattctggctacaagtggtcagtcacagctgatgtagagagcttggcatgggatccgcacactgagcactcttttgtggtgtgttatagttatttctaggacctgagtactaacatttcttttcttttctttacatttttttgataaaacatactagcacttttttatgataaaataataaccaacattccttcagctactaacttttttatgacaaaataataaccaattcttattctgtaagatcaaatttcaattttgatttcgtggatgcacaggtattggttcactaatagtgatttaattgttctgttaggtgagtcttgaagatggtattgtcaagggttttgatatacggactgccaagtgtgattcctcatcagatccgagttctacatttacacttcatgcacatgacaaagctgttacctcagtatcctataatccatcggcacccaatgtatgtatcttcaacagtttggttagaatatcaactgattatatattttagtttaacctgtgccctgttgacatgacttcatgcagcttcttgccactggatccatggacaaaacggtaatagtgaagtcaattttgttatttttcggtatactgtactttgcagattggaattcatctcatttggctgctattatttctcacaggtaaaactttgggatttgttgaacaacagaccctcttgtgtagcatctaaatctccgagagcagtacgtttccttctttttttattttttaaatgggaaagcttcaacgaatcataatatatttgttaaattggcactgatgactggtatcttttttatggtgtttgtttgttagggggctatctttaaaatttctttctctgaggacaaccccttcttgttggctataggaggctcaaagggtaaattgcaagtaagtgaaaagtgcagatgaacaatactttcgttttcttgatcgttctctgattcttggtgtgaaattgacttgactgttgtaacttgttataatttgtaggtatgggacaccttatctgattctggcatctctagaagatacgggaactacaagaatagatcgcaatctgggtcttgatataattgagttgtgctgctgaagttgtgttgcataaatcaaaattttgggattcactgcaaaaatgcttttttttttttttttgcatcctaataaccttatttgaaataacagatttgaatgggttgaacataaattgttttatgtgattcaaacactatatagttttttactttttagtttggacatctttttggggacaaaacccaaaccactaattaagaaataaatggttgagatgataacgaaaattacgaatactaacatctaacattttttgataaaaaaaactgtaaactttattgtatatttatttaattttatcagttttaaatcaatggttttctaataaaaaattgagtgtatttatgttctatatctccattattttagaagcacaaaatccttaatacatatatacgaaaatatactcttgaatatttcacataactataaatatccgaacctttcgaaataactatgaacctaataatactatagacaagagactagaagcaagtaggaacgaaaatagactaggtcaagttacgctttgttagatctaagctttagcatgtttacgtctcaaatgactttttaaaaggcatgtcttaacatacataaaagtttgacatgatttataagcgtggttgatcaaacaatgaatgaagcctaaagaaagagttttagttattttatttttgggtcgctctttctttcttataagtatgtttaaaagtttattttataataatttaaccttgtgatagaggtgaaaataggaacttgagactttgtaagaatgaagttttacttgtttatatgatatgaacatatttttaaagtctaatataacattcatatgataactcatttaaaaatatattttacagtaaaacccctaaaaatgactaaacttatctttcaataaatcttaaattattcattttttaataaaccaaaaataaagtttatctttcatgatgcttaaaacgggaataagattgatactgtattaatgataatgatttatattttttatttatggtaatttttagaaagtatacttttaatttggatttgttgtaattatatatttattatgattaatgaatttctgcacatatttacgcataacgtattttatatattttgagaatagtcaatttgctttatcaaaaatatactatatctatgtcctttttttttttttggtagtgaatatatactatatctgatatgtgtatgatatttgtgtatcatctctaattaatatgtattgcagtataaaaataataattaatatgtattgtatttgatatgcgtttcatatctgcatatcatatcgatatgtcaaatatgtatcatatagtgccttccataaaaaaaataaaaaatatgtatcatatagcgggtatatttgcaaattatctttactattctactattcttaattatcacttgagcaagtgggaggaaccattttgccataaaccgtgggattaatacaggctgaaatttattagaagttgcataatagggtctctcatctcttgtttaatactaagctattaagtttactcatgattttgtgtatttacaaataaatttaactccaatattttgtaattttcattttattttcggatgaatgaatttgaattattttaaaaaataaatcaaagtagcaattaatttcctaataaaatcttattaacttaaaatttcatgatgcagtttgtaactttatcaaataatacaataatcaacccgtgcacttgatattatataattataaaattattagattatttaattatattatataaggaattataccctacgtgtgcttacgatcttcgacgaagattaatcattattttcgatcgagttacttcatatgagtatcatggtataacaaaattatataaggtatttcaaattgaatttatctgatggtaatttattcttttaacagaaaattaatttcagttgctacaacaatttgccgctgcattaaaatgtttttacagataaattgttattaatttactgttttgaataaaagggtagtcttgaatatagggggaaggggtggttggctatgaaatatgatatcgattcctctgaacaacatggtaactttgagtgtaagaaatactttggatgtcatcttacttctgctgtatgattggacatttttctatagcttcttcattcttcttgttcatctttgactgaggttctacagtggctttaccaaagcatgtatacagtcattttaattagttggtcccgatcatgctgcaaggaaaactttctagagcagtcatgtattactattttactccttagtgtggaaattggaaaatactccggacatggcattaaatattctattgtgctaaatctaaacataaagcaaatgtaatgtatatgggctcatttaataagcagttgaaaaggagccatgtctatactaacgttagcagttaaggttcaggcattcagcagttatcatgtctcaaatcttaaatacagccaaaatagcttattattagttcattactacgaggatcgggatttatccaatccatttctatgattagcattatgattcctatactgataatcaaacacattttttacaagattcaattcacaatggatttgtagaaagtggcagaattgatcaaaggaagggtccttgcgtggttattccctttctttttctcgctttgtgagtatatttttcttatcggcctctggtgtttaaaactaagaattagactgcacttgtgcaagcattattgttaagtcatcccgaaaagaataatacgggacgcttccaagtaccaaccaattccaaagtgctgtcaccttgctgtttcatgtagctatctgttttgttttgtttttcttttcattttacattccaaatgtccctgtattgtgttctaataaactttcctttgcgtttgagtagatcaagtagcagaagagcactgcatcatctttctacatcatctttcagcagaacatctcggtgttaagatccaagcaagagagcactgtcctgttagtctatctaccattttggtgagctgatcacagttgatatcttatgtaaactattccttcaagcaattttacggtcttagacaaaatatattaagggggtgcttgaaaacccttagtttagttgaacacaaacatcatgcaaacagtagattcacactttccaatgcacaaaaataggaagcaaccatatctacgttgaacatgggtttgcaagttttcaactgcaaactgttggaagtgcattggaaaatgggaaatgagtaaaacaaacacactccactccacactctaagcaaccatcaacactcaacttatttctagtaacgtaattaactaaggtctttgagaaatatgttcaatgagtgacttgctgtaatgacgaaaactcaaaactaaatttagacaagatccaacaaggatgttctctctaaggtacaattaaacaatcataatcaaagcagcttaacaccagcttccctgagagaatcaacaaccgctttaaccttaccatgatacttctgctctctcttcaagtgaacagaaacagcgggaatgttcttaagcaaaaggcgttctgctagtatcttcccaatctttgcagctgcagccacatcgcgactagtttccaagcttgatctcaacgctttctcctgcgagcttgcagaagaggctacagtagcagttgggctgtgaatcacctgggcactcacatacttattggtaaaatgcatcttcagaacataaggtttgagaaattgggtaatcctgggaggcctcactgggggtgggataaccatatctgttttacaatataattataaaaaaaaaaaaaaaaaactttttgtgtgtgtcatttttggcatacacataaaactcaagaaatgaacgactatcttcaagaaattatcaactctcagccaagcatttcaatgtatctacaaaatgtaagttcatttcatgtttagtaaatgcaaatttcaaaacatcaactaaatataaatttcaacattcaacatcatgtaaaaatacaaaatgaccgagtatgtaattgtatattaaaaaacccaaaaagcgaaagatgagttaagttagaattattgggcaaatatgaaaaaaaaaaaaaaaacgatttgtttcattggcaactttgatcaaacagttgaaaggcaaattgcttgacttaacgggttaaggaaagaagaatgacgaatataagaaatggaaggaggcagagagagaaggtgaaagggggaaacatagatacctgaattgagctgaataagatccaaggctctctccctctcgctctcgctctgccctcacaagtcacaacccactttctcaaataaatgtttacgacgctgtccttctaatatcttctttctttttccctgtcctttttaatttttttcttttaattcttaaacaaatattttacgtaacttttttgtccctatatttctcaataattaattaaataatatattgataaggttaattaaaatttatccaataattcgcacctattagcttttttttttactttaaataatgtataataatgtattaattaatatattaataaaattaattaaatactagtaacttattacttgtactatcacgatatcgccactgaaattcaacttagtgaaataaaaatcatgaaattttattattattattattgttattaacacacatttgaatttttcaattttaaaagaataatttctaagaaatagtaagaaaataattagagagttttttaggttaaataatagtagagaattagatgtaattttttttaaaattttttatgtatatcaattgacatgtaattgttcgtgaattcgatttttaaatatttaaaagaagaatatagtctcaaataatagtactaccatgcttataacatataaaaaaataattatttgttcgaaataacttcaaccaaacacataaaaaaggattattaggtaaatttaatgatttattcaaaatatatgaatcccttaattacataatatattcttgctgctttttagaaaaatggaaactgatttcgtactaatcacacgaatagttgtttccagttaaaacaaacaactttatctttttttttttttagtttttaatttataattatttaaaaagatctaacaacttatatctgatgattcgtatgttttgtgcatctgttttctcgtacttaatagcaataatcttaaaaaaaatattgttcgagctattttagaaattaaatttgaacaattgtttcaactaaaatatagttaatttatttttttaaaattgataattaaacataatttcataattagcattttatttggtccttaaattagaggaaaattggcttacacacaatgttaaaggcataatttaatttttcacttttttttggagaagtaattatatttttcactaagaccaagtatccttatttgaattaagataaaatgtttcaaaggtatctcaccaaagaatcaaagtgataagggataatgctttgaatgaatttgtataaacttaaaagaaataatttttactattagaaaatatatttttaatgtagtcattttaatattaattttattaaaattaatgttaaaaaagtgtgataatatatttgtaaataaattaaatttattaacatcatttttttttaaaattgatgtgaatatcagttattataaaatttaatgttgtttgatgcttattttcattgatttttatagaaagtggcattgtatttttttccaaattaaaaaattcaaaatctgtttcactctcttattttcgcgctcactctcaccactctcagtccacttccaaaatcccaaaacaacgcttcccaaacccttgacactcacttgcgacactgctcgccgttccctcatctctgaagtccgctgcgatggcgtctacatcgtttcgacgctgctgctgcgatggcatctacgtctacggcgtgaactctctttgttgtctttacccttcgtcagccatcaatcgccatcgtcgtaattctctaaggaagaatccgtgattgtattattcttactccttctttccttcgtttcttgtgtttttatattcaattattgaatagtactcgttgaggcttcatggaaatatatatttagcggtgatagagtggaagccatcggagctaaagctcaagggttcgctgtctggcgttaaggtcgtgactggtttggtagtggtctttgatgatgaagatatcccttaatatatatatatatatatatatatatatatatatatttacttacttttggtatttctttaatatactaatgtgaggattaaaatctataagactatataattgtaacagttttgtgacttctatccctttctatttatgttttgtatggtagtgatacactagggtgaattgttcaatgtggttgttttaatcatctattattttttaattgggagacaagttgtttgattctattcgcatttgcttcaattctggtttgccttctttccttcaagaaggaaaaaggttagttgatgaagaaatttgttggtggctggtgcggttttagatgctttaactttttaaatatgagagtggacccatgtctgaggggctttgtctgatttcttggaacaaaattcgttgatagtgatagtgatgtcccaattggacaattgaagctactttgctgagactgtaaaaatgatttgcttttaaacaatcacctaatttaatcatgttttacctgattctgataagtcattcggttttgacattgttgttgaagaggcacaacgagctcatgtggaagcagaaagcactaagaatggtatcggtattgtcaagttaatgggtctttacagtggtcagtatcatttatgttatggtagtttacaagtttagtttgttggtatagagttgaagaatactcaagaattgacgcaacttagtggttagtggttagtggttgttgtatgtgtgtgttttatttcattgtttgcttctctttatttttgttgaattctccatgaagtttttgctagtaagttggatcatgaattgagaatatttgttgcttgagatcctaatgtctttttgaaggtatcttaacacattttgcttgtgtttgctagtggtgagaatttgggtagtttgcatcagggaataggttcagacttcattggcactgatgcttaaaaaatgattttagtcaacactctgtattcttcttctgctgatactgatatactgaaactgaaatagctaacaaagtgtatccaagagatcttgcaccctctcttgctctttactggtttcttgcctttttcgttcggcatccctctcctcttaattatctatacagttaaactattccacctaattatgtatacaaattagttttagcattttctcacgaatctaagatgaaatcaattatctatatccagaataatttctcagatgaggaagacagaataatttgcagcctttatgttaatattggaagcaggtataatagttaccaacatttaatgcaaaaacactatcagtataggccagacaatttttttttagccttttctcaccaatcaaagctgaaatcaattatctatatccaaaataatttctcaaatgaaaaaagacagaacaatttgcagcctttatgttaattttggaagcaggtataatagttactaacatttaatgcaaaaacactatcggaatactgctgaccaaattattttttgctttttctcaccaatctaagctgaaatcaatcatctatctaattaagttctcatgcatgccaagttgatccaagtgcaacaccagcatccgctatgtctaattaagatattgagtaaataattttttgttcatagatttgcttcctctttctcatcacaaaaaaaaaccttcatttccatcacctacccttcaactaaagtcaccgtttttacgattactttactttttgagttccaacaaaattttgattcttgcaatagttttaattctgttgtcaggcttgagtttattagtcacatggtcaaacatactctttccaggttgtagaaatccttaaataccggcctttgtggtttcacgactgtcaagctgttgatgttttcaatgtgctacccacaacaaatggtggaaccattgagctgctttataaggcattttcaactcatctattttatgtaatgccaggggtttcaactttcaacgaggcactcaatgggtttactgatgagggatgaaggtcaagttatattgcccctagcacacataattgagcatgaagaggtaataaattgtcactaattatgcaatagaactaatagttttgcaattcgaaatttactcatttctatcttcttcgtgctagtttttggaagtcattaaattagaaggaattgctcattctcctaaagacataataacaccaagagaaaaaaacatggggtgcaacttgaaaagaaacacaagggatgtgagtgtaatttactcttaaaaaatgtacttaatttcaacatcggttgtggttgcaacttatgtaaaaagtgttttacaacatcgattgtgaacaaccgatgtaaaaaagtgttgtcaacatttgtatttgaatcgttgtcgaaagttgttcactttcaatgacggtcgattcaacatcgttgttaaaagtcttccaaaaccaatgttgaaggctttttttgtagtagtgtttacaacatgtgtgttttttttaaatgcttttttaagaagataagatttgattcctaaacaaaataaaaaaaattattttaagtaaaaacaatttagataaacatgagagaaaaataaaaaaaatacttattttattaaaaaatatttttaaaataaatttaaacaaactcgcttttaacattgatgaaaaagaatttttaagtattgaaattttacaattagaagtttatcggttataagttagtgttaactaatgaattaccattaattaatagtaacaagctcaaaccaaacaattgctcggacaaatttacattgatatacaactttattaatcattagttagtgttaactaatgaattatcattaattaatagtaacaagctcaaaccagacaactgcacggacataattaattacatcgatatagaactttattaatgatatgttagtgtaagctaatgaattgccataaatagtaacaagctcaaaccagacaactgtacggacataattaattacattgatatagaactttattaatgatatgttagtgttagctaatgaattgccataaatagtaacaagctcaaaccagacaactgcacggacataattaattacattgatatagtaattatatgttagtgttagctaatgaatttccattaatagtaactaactcaaaccagacaattgcacggacataattaattactttgatatagtacaagtctgttcacattgttaatggttttgaagcttccagactcaagtataaatagagttccatcatattttgaaaacaacattcatcgctaaagagtacaagaaaataaagtttatcaataacaacatggatatgaagttgaatatttcagccatcaatgttttattcttattgctagctatttctagtacaactcaatcggttgacattaatataaaaaaatttggcggaggtgcagatataacacaggtaaaaagcagttgaattccctaaaaaaatgattgaatattccactaattattattattggtattgtgtttgatttgtaatttatatatatgttgtcctcaaggctttgacaaaagcttggaaagaggcatgtgcagcaacaagtgcaagcaagattgtgattccaggtgggtcatacaagatggaagcagttgaattaaaaggtccttgcatggctcccattgaaattcaaattgatggcacacttcaagcaccggctgacccgaatgcactacaaggggctgatgaatggctcaaagtacaatatgttaacttttttaccttatcaggtaaaggtgtttttgatggtcaaggtgcaactgcttggaaacaaaatgattgtggaactaacaagaattgcaagacacgttccaaggtaataaataaactatataactatatagccatttcaattaatctcaaattgctagcacagtcacttctaccaaaacattctaatgagctaaatttcttgtaaacagaattttggtttcaatttcctgaataattctatggttcgggacataacttctaaggatagcaaaaacttccatgtcaacgttttagggtgcaataacttcacattcgatggcttccacgtcagtgctccaagtaccagtatcaacactgacgggattcacattggaagatcaactgatgtgaaaattcttaacaccaacattgccaccggagatgactgtgtctcattgggagatggcagcagaaaagtaactgtccagaatgtgaattgtggacctggtcatggcattagtgttggaagtcttggcaagtacccaaaagaagagccggtagaacaacttctagtcaagaattgcactttgacaaaaacagacaatggtgtgaggatcaagacttggcctagttctccaggagcttctcctattactgatatgcattttgaagatattaccatggttgatgtcatgaacccagtgatcatagaccaagagtattgtccttggaatcagtgctcaaaacaggtacttatatgtttaatcagacacgattcttaaatttaaatgtctttatttgtgaccctttttataatcatactggagttgttattatttaaatcactagtattttagtcttgattgaatatgcactaccgtgaggtttcttataccttgtttttgtctattttgtgcatgcttgcaatggcttagactccatcaaaaataaagataagcaaggttaccttcaagaatattaagggcacttcaaaaaccaaggaaggagtgactcttatatgtagcaaaggtgtaccatgtgagggtgtggaactaaataatgttgctcttacattcaatggagctccagtagttgctaaatgtgctaatgtcaagcccaaagttactggaaaagctcctgcttgcacagcttaagagacttgggttgacacattctccttgatcagatttttcttttgtagattcataagcatcgtcgtaaggtgacgatgaggactatttgaagtctatagtgaataagcatttgtatatacttatgttgtcaatgtctaagggtattcattcaatacgaaatccttgtgcaagagcatatatatatataagactgactttctatttactaaagaaaagttctcatgccggtcacaattgctagctagaagctacgaggctttcctgtcttcgcatatagtgtattctatatatcactattatttatattagaataagagtatatatttatgtacaaaaaaaaagagaatatttataaatatgcttgaaagtgtataatatatttcaaaacaaattgttcaggtcaaattatatttgagatatgtatgccaacttcaaaatgaggttactttattatcgaatgataatgaaacttgttgaagatgaagaagaattatcaacaatcaatcacttatccttatctattaaggtttaaatgaaatcatgtttgtgcaggggtgatatactgtgaacaataaatatgtatatttctgtaaataaaaattatacatgtatgtttatgtatatattaaatttttgttatatgtttgtgtgaaaaatcctaaagtagaccttagccatcaaacacccactgaaaaaaaaatatagtctcgtatttctaaaagaattaatctatatttaatttttttgatattttttatcgggtgcattgttttattagtgatgcttacaaagttctacaaatctatgttaaacgatttggttgtgttaagaatggcaatggggtaaacaagtgtaataaaatactagatagttcacaaaatttgtaaaaatactcaaatggggaaaaataaatccatttatcacatatagttttgaatttgtagcataaaatattcccctttagaaaaagaatcaaaacatatggtaacttattcacgggaccctagatgggtaaccctttaatgtttcacactagtaacaaacaatgcaaaaacctcatatacaatatgctaaaagcaaaccaaaatgacggatgaagaaacaaacaattattgagaagaacccaaaactttgcaagacataaaaggcaaaaaatctaccggaaaagaaaaaggaaaaaagaaatgttgtttgtccatcttttttatattgctgcctcacaagtgatgcatgatacacttccgctatatcccgcaatcagattttacatctcactcaaatcccataacctaaacagcaactcaaaaactcaagccttaacattcccttgtaacctatctctatatctgaaccctcaaaacaggtactccagttagctctagaaaatcaaacatcttgcgtcttaaatcgaaattcggtaacaacagtggtgtgcaaaattcacaattcacctgcttcactggattatcttcacctacaagttcgtgtcatcaaaacgatcttcctatgtagcgattcctgaagtaaatatacaagtttatcagtgttggcatacaagacaactgaaaatgaaaaactaaaaggacacttcacaagtataaagcatcaatatttatttccatccaatttatatgttgatgtgaaaaaattgagcactacaaaggaacatacaacagaaagagtataagtgaattgtagtcaagttttgctaaaagaaaaaagatcaaagataaattcacatcataaagaacttccataacttaccaagactaaagaaattgagattcattgttagaaaaaaaatgaacatagtattacatatcataaagaagaaaatgatgtagaacatattttactcttttacaaagaactcggcgttatatcagccctcttgactaactattaaacatcaagagggtaaaacttcttacattgccctctaagtgggaggggtagagcaccagaggaataacagacaaaaaaaaaacattcaactcttgaatgcatatagcttgctagtttacttcattattaataataataataataataataataataataataataataataaatgttttatcatgtttttcttcttcattaattcgtatttgtgatatgagtgtgaaatcactcgcaatattgttatcaagatatgctacaaatgtttattgttgataaataaaatagcatataatgatattaacattgaagaataaataataataaaagtttgattgtatttttttttctttacattatatttatgatatgagtgagaaattatataaatataaaatcacttaaaatattattaggattatatgctacaaaattagacttatatgtttaatgattatattcaaattaaacatgtcttatattgagtttcatcttgaatttccttaaaaaaaagtttgataaccttgaccaattataaaaatgatgaaaaaggatttttaagtattggaattttacagttagaagtttatcagttataagttagtgttaactaatgaattaccattaattaatagtaacaagctcaaaccagacaactgcacggacataattaattacattgatatagaactttattaatgatatgttagtgttagctaatgaattgccataaatagtaacaagctcaaaccagacaactgcacggacataattaattacattgatatagtaattatatgttagtgttagctaatgaatttccattaatagtaactaactcaaaccagacaattgcacggacataattaattactttgatatagtacaagtctgttcacattgttaatggttttgaagcttccagactcaagtataaatagagttccatcatattttgaaaacaacattcatcgctaaagagtacaagaaaataaagtttatcaataacaacatggatatgaagttgaatattccagctatcagtgttttattcttattgctagctatttctagtacaactcaatcggttgacattaatataaaaaaatttggcggaggtgcagatataacacaggtaaaaagcagttgagttccctaaaaaaaggattgaatattccactgattattattattgctattgtgtttgatttgtaatttatatatatgttgtcctcaaggctttgacaaaagcttggaaagaggcatgtgcagcaacaagtgcaagcaaaattgtgattccaggtgggtcatacaagatggaagcagttgaattaaaaggtccttgcatggctcccattgaaattcaaattgatggcacacttcaagcaccggctgacccgaatgcactcaacggggctgatgaatggctcaaagtacaatatgttaacttttttaccttatcaggtaaaggtgtttttgatggtcaaggtgcaactgcttggaaacaaaatgattgtggaactaacaagaattgcaagacacgttccaaggtaataaataaactatataactatatagccatttcaattaatctcaaattgctagcacagtcacttctaccaaaacattctaattagctaaatttcttgtaaacagaattttggtttcaatttcctgaataattctatggttcgggacataacttctaaggatagcaaaaacttccatgtcaacgttttagggtgcaataacttcacattcgatggcttccacgtcagtgctccaagtaccagtatcaacactgacgggattcacattggaagatcaactgatgtgaaaattcttaacaccaacattgccaccggagatgactgtgtctcattgggagatggcagcagaaaagtaactgtccagaatgtgaattgtggacctggtcatggcattagtgttggaagtcttggcaagtacccaaaagaagagccggtagaacaacttctagtcaagaattgcactttgacaaaaacagacaatggtgtgaggatcaagacttggcctagttctccaggagcttctcctattactgatatgcattttgaagatattaccatggttgatgtcatgaacccagtgatcatagaccaagagtattgtccttggaatcagtgctcaaaacaggtacttatatgtttaatcagacacgattcttaaatttaaatgtctttatttgtgaccctttttataatcatactggagttgttattatttaaatcactagtattttagtcttgattgaatatgcactaccgtgaggtttcttataccttgtttttgtctattttgtgcatgcttgcaatggcttagactccatcaaaaataaagataagcaaggttaccttcaagaatattaagggcacttcaaaaaccaaggaaggagtgactcttatatgtagcaaaggtgtaccatgtgagggtgtggaactaaataatgttgctcttacattcaatggagctccagtagttgctaaatgtgctaatgtcaagcccaaagttactggaaaagctcctgcttgcacagcttaagagacttgggttgacacattctccttgatcagatttttcttttgtagattcataagcatcgtcgtaaggtgacgatgaggactatttgaagtctatagtgaataagcatttgtatatacttatgttgtcaatgtctaagggtattcattcaatacgaaatccttgtgcaagagcatatatatatataagactgactttctatttactaaagaaaagttctcatgccggtcacaattgctagctagaagctacgaggctttcctgtcttcgcatatagtgtattctatatatcactattatttatattagaataagagtatatatttatgtacaaaaaaaaagagaatatttataaatatgcttgaaagtgtataatatatttcaaaacaaattgttcaggtcaaattatatttgagatatgtatgccaacttcaaaatgaggttactttattatcgaatgataatgaaacttgttgaagatgaagaagaattatcaacaatcaatcacttatccttatctattaaggtttaaatgaaatcatgtttgtgcaggggtgaaaagggaaaagagcacatggtgtacaaacttaagaaatcaatatacatatttaaacaagcttcaagacaacggtaccttaagttcaatgatacagttgtttcctttggatttaaagaaaacactattgatcaatgtatatatctgaaggtcagtgggagtaagtttatattactgattatgtatgttgatgatatcttgattgcaactaatgatcttagttttttaaatgagactaagaagtttctctttagtaactttgaaatgaaagacatgagtgaggaatcctatgtgattgggataaaaaaaattatgtgatagatcacaaggattattgggtttgtctcagaaagcatatattaatacatttttagagattagaaatgcagaactgctcatcgtctccagtaccaattcagaaaaggagacaagtttagtctcatatgcatgcaatgtcctaagaatgaattggaacgaaagcaaatggaagcaattccatatgcatcacttgttgggagcctaatgtatgctcaaacttgtacgagaccagatattagctttgtagttggaatgttgggaagataccagagtaatcctggtatggatcattggaaagctgcaaagaaagttatgagatatttgtaaggcactaaaggtcacatgcttacttataggaggtctagtaacgttgaagtgattggatacacagactcagattttgcaggatgtatggatacaagaaaaattacttatggttatctgtattttttagctggaggaactatgtcatggaaaatggaaaagtgtgaagcagtcggtaattgttgcatccactattgaaactgaatttgtgacatgctttgaagccatcgttcaggctaaatggctgcaaaaatttatttcaaggtttgaattggtcaacagtattgatagaccgctgaaaatttattgtgataattcagtaacaatcttcttttctaaaaacgacaagtattcaaaaggtgttaagcatatgacattgaaatactttgtcgttaaagaagaggttcataaacatagagtgtctatagagcatgttagcactaattttatgttagctaatcccttgacgaaaggattatcgtccaagacatttattagtcatgtatgtagtttgtgcattatgtcagctaatgaatgttggtcattattgtaattattgactattgacactctgaattcaatgatgtttaagtttttaaatattattatgttttcaaatttatatatacatgcatgtatgaatgattattttgaaaaataagatttgtccctaatgaagacatataataatattattgtgggacattatgatgtaaacttttattaaagtatcatattaggaagaagagttaataaagtggtacatggaaggaattatgtcgatttgatagcatagaaccgtcatgatttttattagttttatttctgatcatgatttatgaggagaccagtgtatgaaaactttagccctatgtatgcgcattataattgttttcattaaatcatgaaatgaaagttgtgatatgagccaagtgggagaatataagatttatcattgtggctcatttaaataaatgttatttgatttaatgaataaaggacataagggtaattggttacaaagagaagttattaaaagaataactgttgataggtgcaattatcttaaaatgataactgttgataggtgcaattattttaaacttagtggttcagtttctaataaattgaaatttagaaaactgaatacattcatttgtctgtccatgaaagttgtatcttatccctattaaaagaagttacaagaattgaaagggttaagaccatgagaaaacatcctaccataaaagatcttcagtaatcatggacaaaattatgtttatgtgaaactcatgaattttaaagatcttattcataagatttgatgtgtttgttttaaacagaaattataaatttatatttacacaaaacacaccagtggagctcgtgcgccacgcccaagaactcataatctttctcgactccaaaacattcactcgtgaaagtaaacgcaaagagaaggtaaattaatgtcttccttccatcacataattaaaattacgtaacttgtcttacctgactgtgcattcataattaaatctaagattgttttttttcttttgaaaaggcaattttattgcaataaaaaaatttgacacacaggatgtgttccaaattatcaaactgaggacacgagaaattctagacatacccccgtcaagcacaaggttttaaacagcagtccgcaatcgcaattgcagctgcgacgtcaaggtatttctgcaatcgcatcatgaccctaattgtggttgcatcattcgtattttcttgcaacataaaggttttaaacaacggtctgcaatcgcaattgcagccgcaacatcaaggtatttctgcaatctcatcatgaccctaattgtggttgcatcatttgtattttcttgcaatataaatttttttggctaaccgcaaccatgaccacaatttataaccatgatcacaacagaaaatgcatcaggcacatacaacctgttatttatcaaattatgcagcctgaaaataaaaataaaaaataccagaagctttgctcagaattaataccctaatatatacgactgccaccgctatatcatacttcgcaagcaccacaccagatactcaaactcttttcacgcttcagcaccaacataacatgcacgtacaacttttgaaaaaactgatatttgatactttttaaaattacatcagtttcgtcacttttttaatatcgagaaaaaacacaaataaataaatatggttgatgtgattacaattatgattgcgttgtagttgtagacattaaaaattaaattaaatgttgacgttgcaatcaaaatcatggttgcattactatttttttttatgccatgcattactatattttaaaaccttgattaaatcatatatatatatatatatatatatatatatatatatatatatatataaaatgcatgcgttgcagctatcagacctaagcaaaacgtactggagataagaacggttctttatggaaacggagaatcagagccaaatgctgatgcgtgttctcagatcacatgagagtttttcaaagatgacacatttcgcattttcattctctatgtatcaaatcttaaactcggggtagccatttttatatttcaccgtcagttacattatgtttttttaatttctctttctagcatatttaagaattaattcatatatatatgtcggtaggcacgccaagatgcaacccacgtgattgcaatcttgcaaaggcagcgagttaattcaattcgcaactaattgcttctcagtacctggaaaaaaatatagatcttgtggagatgctcatagacgggtaagaatatttatgggatattccacattgaattttcaaattttatttcatagtttcagtactgtgctggataaatggttaataaaagttgatttaattagttatgagaaagagggtgacattgctttgacgtatggtgcggttgcaagggagtgcatgcgccaccagagcgtagcaaggtacgcgattccaatcatcgacctcaattaattaatataatcatgcaatttattgagttatatatccaacatgaatgcttgtgttaggatcataattcttaattgttaactttcggagattaaaaaaaatgtagccaagcatcttgcatggctgactttggaattttactttctttttcctcttttttaaattctgactagcttaatttatgttttttaggcatattttggaatcagagcacatgaagaagttttctgattatattcagctaccaaattttgaaagagcgtcagatgctgttgcaacttttaaagtatgctaattatgatgctatgtcttttaatttccattcacaaatctaagcctaattctcattatttacatgttcttcattttacttgcattgcattgcgaaaaagtcccaaaatatatctctagtatattgcatacatatctacgtacgttatttatattctatattctatattggacaatggagcaaaaggcataaaggatactgcttttttttcgcattttccgagagaaaatgaaatatgtgatgaaagaaatatacaaaaagaaatgtaagagaaactatcatccataatatatttttatcttgcatcttcttatttaattttcctttgttttatgcgacatccaaacaaataatatctttaaactatccaggcttaattatattgatttgaatgtatgtatgcgaagaactctttgtatttgggaatgtgttttatgataattgttttgtataaataggctttgacatgtaaaactgatatcacaactgaaaaagtcgattaactaaaatgttttatttttatatcaataaatattaatttgttaattttgttagaattgttaattttgaacttataacttcttctctccaactcccttcactctaagtcttcccttttcaaaaaaataaaaagtcatccttatatctccctaattaactaaaatttgtcatataatgtgttgctataataaagttctgggtactactattttgctcttacagcaaattcattagcatgaaattaagctaatccattccctgactgatgtacacaggagttattgacaaggcacaaatctacagttgctgaatttctttctaaaaattatgactgggtaagtacgccaaagtctacttagtatataattatgtcatgcaaaaggtacaagtatttatcctctgtaaattcgagaatgtaaaagcaatcaaggctgtagaagagggaaagaattttcccctatcattgttttatctttttgtaaaagtttaaattagacaatttaatttggtttacaaagatttcatcagttgtctttagttggtggcttcctcggtggaatgtaaggtttcgtaccttatatataattgaggtcaacattcacaatgaggcagatatgaaccaaaaacttattcacattggagtcaattatttgaataaaagaagtcatagcttctttcacaatcctcaaatttattctaacataagtaatttggttgttttcatacaatatagctttttaagttttttgtttttatcaatattttaatatattatcagctaaaacgttttactgtgcctgttagttcttcaaagagtacaactctcagttgcttgaatccaccagttattttactagacggtacgctatcaaggtataaataatttaatctgtggtagattccttaagtctcaaattcatttcagcatcaattgtccattttaactgcttgcattagtcacaattttttatccatttcaccattgtaatcaaattaatatgttacagttattgggggatatgttattggatcgctcgaatgctgctgtaatggtccagtatgtgagctcgttcgataatatgaggatcctcatgaatctcttaagagtatatatgcattatcctatactcaaatttttcagaattgtaaattcatgaaataaaagtacttattaatttgttcactccccccccccccccccaatttgcaggattcaaaataagacaattcaattggacaccttacacgttttcaaggtgtatattgaaatggagcaagtatatattttttaatagattcttctaaactcagtgttcttagtttaaatttaattattttaattgacagctatttgttgcaaatcaaaataagcctcctgagattgtcagcatccttgttacaaacaaacataagcttttgcaatttttggacaactttaatagcgacaaaggtataaagttgttgcttcacttctagggtataaaatttctaattttttaattggtcgcatgagttaactctatccttccttaacttttcagcggacgatcattttcaagcagataaacaacaagtaattggtgagataataactcttgaacacaaggatcgtccatgcacatctttggacaattgtgaagttccatgttgaatacttacagtccggatttttaatcatctttcaatttctccaagtcacattttgctacgtgaagtcgatcgtgttatttttttcttttccacatgtcattctcaatgggaagaatcaaatatacttcactgtgaatagaagatacaacgaatttggattaacttattatttgaattatttatttgtttaactttatcttctgttatatttatacacttgtataagtcaagaacctttccacaccaacaatttctatagcctcattatccgtcacggctgcaaaaaagcatcccagcagcaatcaattctggactgagcatgaagcggatttcctcctatatctgacatttacaagcaaatttattgaacatcaataggctaaaacaaaatgttcacgtgacaaatatctcaacttacaaaattacaaaatgtacacgactgcatgcatatgcttatatcaggaactatggtataaaagctatcataaatacctaggtataatggatggaaacaaaaaacatattgtaactgtgaagtccccatgccaaggacatctcccccaagctttttacttgcaaaatataattcaacggctacacttgattgattttccaagtggcctgaattgagaagctattacaatgccaaagtattaactattaaaaaccaaatgaatcattaaaaaaaactgaaagaaattagttttgctgacaattgaaaatagatttccttcatttaccaaaacattgcatagaggtgtacgagtcgcgccccaaagctccgcctcgggatcaccaatattagagtaatttttgaagggaaatactcttcgctcaaaggagacaatgcccttaggcatatcagaacttatcctttgaaaatagtgaaggatgcacaaaaccttatcttgcagtttttcattcatatgatcatatatatatacacactcctgaaaattaagaaaaaccttggaatattgcaagagaaaaaaaaatggactacaccaatgaccaatatcaatttcatctctatgttgcagcatgctgacactaaaaggatcaaatttacgacaaaaaatgagcaaaggattccttacgcaaacaattgatcaaagttgatcatttgaaggcctttcacatggttgtgatcgtctgggaatagacaaaataatgagcaaacaagaagagtagcaaccaactcctgaaaagcaatcacagttgtgcaatacttatgacttcagaattttcattttggtttagaaaccatcttggaggaaaaaagtagataaaatgtaataataagaaagtaagtaacctggctaaggcacacaaagcctggttggtgcgattccaatatgcgaagagcatcttggtagtgtgcttccaacaaagagatagggcaacctccagagctagcaaatctgccaatgcaggaagcacgtccttaaaccactttctagattgctctatagtcataagctgaaattaacaacgcgacacgtcatgtcatgcatgtactcggcaaaacccatgcacgtcaacttaccttgtcaaagaagaaggcatatccacggatagcagaagacttgttgggagggggagagaaagcttttctgagtgcacaaatggtgcgtgccaagtcatcggtcatttccaagagtgtattatttgaggggattgaatctaggttctcttatacatatgttgtcactaaactatatatattcctttatatgagaagttatattcaattgtctttaagtttaaattctacattttttactttttttcgggataatgaatttattgtgtttctggagttaaggagataataacaataattcaattcaatgttatctttaactaacataagacaattaaagatggtgttatgacgacgatgacattaaccaaatcaataacatttacacgtagaaggccaaattgaaaatctgtaatatatatagaaactaaattatgtgtttaaccttacaatttttttctcgaagtttgggattcaaattatggacataattaaaggacgagtaaaacacacatttcatttgcttaaaaacaaaatggatgggtaaaatttcagaagtagaatgattatggcatagcttcaaagccaagcacaatatgcaaacatcaaccttcgtatctcgtgaagacaatgactataatcaaaaggagtagccgcactcgatcgacataataatatctcgtttgatatactatattgccctctactcccaccactagatacaaattttaaaacccgatcacattgtcccatttctaccaaacgcacaacaccaccttgtctttccttcaaagtcaagcatcaaactacatactatttcgcacgtcaaagaaagaaagcactaacgattctcacttattacgagctcaaaatccataatgacagctagcaaaaattggttagtaagaaataataaaaacatgagtatgatttttattgacgatacgaaaattttatttgtagataatttgtaagtaaatgtaaaaattctttgaattttaatttctatcctaataatgatgaagttgggacccatgcaactcacataaacttttttaataataaaaaaatccatgacactcaccctgaacacaacattgttgttaacaaaagcaagcattgaaccatgaaccattaattctctcccagtctatccatcacagatccacggcaccaccatgctaattcttctttacctctcccttgtgtgttcacttccccacattgcattgtcatcccattgcaccgtggaaaccgccacgaaaacgttcgaaaaatgcatgaacctcccaacccaacaagcctccatagcatggacattccacccccacaactcaaccttagaactagtcttctttggaagcttcatatcaccttcagggtgggttggatggggcattaatcccacatcgcccgaaatgaccggaacacgtgccttaatagctttcccggacccaaactcaggccaaatagtgcttctatcttatattcttgaccccacagtgaagcttcaaaaatctccactgctctctcgcccccttgacatccacctcctctcctccaccgccgccatgtacggaggcaaaatggccaccgtgcacaacggcgccgccatccaaatcttcggcacggtgaaactgaaaacgaacaagaccaagattcaccttgtttggaacaggggactttacgttcaggggtactcgcccaccattcatccaactacttccaccgatctggcttccattgctacctttgatgtgttgtcgggttcgtctgctccacagcacacggatctcacgacgttgagagtgatccatggcaccgttaacgccatctcctggggcattttgttaccaatgggagccatcaccgcacgctaccttaggcacattcaagcgctcggccctgcatggttctatgctcatgcaggtgtgatcatcaacacaattctccatattactctttaatttcaaccattcatatttttagtttgactagacagtaaaaagctaaaaaaagaaaaatataaataatatgatatgatataaaaaatataaatgttaataaaatgtttagagtgacaaaatattcacatatcactaatctttatttgaaggatttttattccattataaaagattgaaatattccacaaacacttcaaatccatttgtttatcaattctttttcttgtgttactttctcaattgagtacatattacaaacaccctcaatgagtgtccacaaaatatatattttttagtgttatttgtgtatcagaattagactaccttaatcctctaatataaggattataagtgatatataaaaaacagaaaatagaagagcgtatgcaatatgttatgttatatgatttgattaaaaaaaaacataaatataaataattaatatatatatatatatatattctaaacatatccatatatcattaaattaatgatttaaaaaaaaaaaaaaaaaaaaaaaactcttcgggcagtcatttaatacttgtttgacaatgacttgtgttatagtagtaattgcttaatttgatgataataagaaattggacggaaaataaatattatgcatgcaggaatacaactgtttggtttcgttctgggaacagtggggtttgtgatcggaatccggctggggcaactgtcgccgggagtagagtataggctccaccggaagcttggaatcgcggtgttttgtctgggggctctgcagactctggccttgttatttaggccaaagaccaggaacaagttcaggaagtactggaagtcataccaccattttgtaggctactcgtgtgtggtgcttggctttgtgaatgtgtttcagggatttgaagttatgggagccagcagatcttatgccaagttgacttactgcttagggctctccactctcattggcctttgcattgctttggaggtcaactcttgggttgtcttctgtaggaaatccaaggaagacaagatgaggagagagggactcattggaacttccgacaaagccagtggaagtgccatccacaattaacattcctcattattactctagtatttcatttcattgttccttaatttctcttttaattcattttctatccaatgccaagttgtgcaattataaaggttttgaaatatacttcctttgtctcaaaatgaatgttgtttaagattttttcatacatatatgtcaaaaaaaaatatattctaagcgaattaatattaattaagatatcattcaatttgaattttttttcaaagattaagaagtaatacatacatactttcactagcttctattaatgtttcttagcaatagttcaaacatgacgcatgaattaatgatcatttgggagttccactgcgtcgaaaggtgatgcaggcaagaaatcattagatgatccactattattacttattcatgatttctatcatttttatataaaattaataacactcgattaaatgtaatgtaaaatttgatagtgaatatgtggtccaaaacctttataatttctcgcatgccacggggaaatgtcaagtgtccagtccacacactcccacactactatgtaaggtttgtgagagcaattggaggattaaagcggaaaagagtgaatttttttattgggctagcattaataccttcggacaactcaaattcacgggtattaagttgcaagttgaaacatctcctctccacttctaaaataaaactttgagtattttgaaattagcttctattaatattcattaacaatttttcaatcaactagctagtatttgctttaagagtaattttacttcataatatctaaaccatttcaaaacttaaaataaattattttatcatgaattcttttatttaagtccaaaaaaagtccaagtagccaagcaccacacaaaaagaagaatggaaagtcgtacgagaccatgtctattcctacccgttataacttgtatgttattcgatattcgttgcttcccactatccacttacatggcttttttttaaatagaaaaaaaaaaatcccagcagagctataaagaaatcagtcaaatgacccaatgtagaaatagggcaaatgaaaggatgtgtaaacggcataacatatagaaattgtattaaacaaatacaaaaataggaaacaggctcaaacgaggagggaagaaaaattaacaatatagaaggttttcactttattcgacttcatgtcttctgacttctggggatgtaatattactttccaaaatcagccaacacattttttcttttcctaataaatatatttgtttggaatgatgctttcgaagaaagtttttgtttgacaaatatttaaagcaaaaagaatctcccaaagtcttttgcttttgatttgtctgtctcttgatctaaactaaaaaatatcttctataggatatgatattattcgactcaaaaaacatttatatgatgataaaattaactctaaagattttcttttctatacacaactggaactcgaaagacaatttttatttagtaaaatatactgagttagttaaaatgttcaaaatatctttaaaaaggaaagaaaggcaagcagaaacagattttagaaaataacaattgaatacctttttcaaatattttgaaagaaaaacaagcaattttctaaaattgcaacaagtcaataaatacaaacacacaaaaaagtcatttttcagctaaaacaaaaaaaaataaggaaccaaatttaatcgtttatttggcctcattatttatttatttaatttaattttgtctcactattaataaatgactcaatttggttccttaatttttcaaataccatgcattttagtaatttttcgtctaaattggtctcatgctgttagaactttttacaaattaaggaacctaattgaatcattttaaagatttaagagatcaaattgaatcatttattaatagtggaataaaactgaacaaaataaataagcaattaagccaaaaaaaattgtttattaccatccatcaaaaagtcctgcaataattagatatttagaccacaagagttaaattaaagaaaaacaatatcttaaatgcctaacattaaccctcaggaagattgaagatcggaacagtttctaatctactcaagaaggatgtgctaaacaggcaagtacaacacctaaatccaatttatctatctatctatatattttatatatctatacttaaagtaaaggaagtttgaagtattttaaaccattatatcaagattttaatttcattatcatttttaatttgatttaatcttatttagtcattgatcaaaagttacaatacacaataactattgatttagtttaatcaaatagaatattagtgaaggattaaattgacctcattaatgtaatttaaaaaaaaatatttcactttaattattaattaaggatagaattatttttaacaaaaataattaaagatataaatttagatatatatatatatatatatatataatgtttcatatgaaaatgattttgttatgtaagaatgagaacattcaaattaaaacattatttaattataaaatctctaagatttattaaagaaaatcaaatattttaaagatttaatttacatcaagatcgtcttcacaatcaccattattgtcacaaccatcatgatcgaccaccatcattatcacctagataactgccacaaatccacctacatgactgccacaaatatcatatttaattttatggttaaatgatactttaatttgaatttaaaatattttaattgtgacttttcattttcattttaatttaatagataaagagaatggttgttctaatacatcaaacacccactgaacagaaaatccagtctagtatttctaaaagaattaatctatatttaattttttgattttttttattgggtgcattgctttattaatgacgcttacaaagttctacaaatctatcttaaacgatttagctgtgttaagaatggcaatggggtaaactaaactatagtattaaaatatctataaaagcaagtgtaataaaatactacatagttcacaaaatttggaaaatattcaaatggggaaaaataaatccatttatcacatacagtttgaatttgtagcataaaatattcccctttagaaaaagaatcagaacatatggtaacttattcacgggaccctagatgggtatcccttcaatgtttcacactagtaataaacaaaaacctcagatacaatctgctaaaagcaaaccaaaatgaacggatgaagaaacaaacaattcctgagaagaacccacaactttgcaagacataaaaggcaaaaaatctacccaaaaagaaaaaggaaaaaagaaatgctgtctgtccatcttttttatattgcttcctcacaagtgatgcatgatacacttccgctatatcccgcaatcagattttacatctcactcaaatcccataacctaaacagtaactcaaaaactcaagccttaacattcccttgtaatctatctctatatctgaaccctcaaaacaggcactccagttagctctagaaaaccaaatatcttgcgtcttaaacccaaattcagtaataacagtggtgtgcaaaattcacaattcacctgcttcactggattatcttcacctacaagttcgtgtcatcaaaacgatcttcctatgtagcgattcctgaagtaaatatacaagtttatcagtgttggcatacaagacaactgaatgaaaaattgaaaggacacttcacaagtataaagcatcaatatttatttccatccaatttatatgttgatgtgaaaaaatggagcactacaaaggaacatacagcagaaagagtataagtgaattgtagtcaagttttgctaaaagacaaaagatcaaagataaattcatatcataaagaacttccataacttaccaagactaaagaaattgagattcattgttggaaaaaatttgaacatagataacatatcaatatatcataaagaagaaaatgatgtggaacagattctactctattacaaagaacttggggttatatcagccctcttgactaactattaaacatcaagagggtaaaacttcttatattgccctctaagtgtgaggggtagagcaccaggggataacagacaaaaaaaaaaatcaactctcctatgaagatttgattgcatgcaaatcatgattgcatactctaaacgtatgcagcaaaacatctaaaatctatcagacaattcagaaggaaaaggacatcgaagaactagttctagtatgatgtttacatgacatctatgattgctatccagaagtcagttttcttcccctcattcaaattttgtgaaagacactcgaaaaaagaaggcaatactgttgaaaagagcccggaatatatatctatatatatgaaaatgatcatttctaacaattcaatggaattatgggcaacatgtttacaaattttttctgttttttttttctccatctactaactcacaaaattacaatcaaccatgcagattttgaatccacagatccatacccaactgttttcattggaaaagatgcaattagacaagagtcattatgataatctccattgaaacctcacctttattaagttatacagcttctacaacttctgttcatgaatgaagtaatacttttagtttgagaacttaatttcattaaaatacttctgcatgtgcacattgtaaaagtatgtgtaaggttgagccttgcatctagcagaattcaaactctacttataccaataaacatctgaatcactaatagaaactttataatatataaaagcatatacccctccttattcttttctataaaatataaatcaacattttgaaattatgagtcactatgaaattagaggaaaaggtgatggagcatagagattaagagaagaaacaaggattgtagagaatcaatttgattttatgtcacaaaggtgttatttctggttgacggaaaggtacagtaataaagagacttacatatggtttttattgacttggaaaaggcttataattcatgctatacaagacatgtatgaagtggtaactactagtgtgagaactccaagtggtgaaactaaggactatcctattgagacaggattacatcaaggcttaaggcttgagtccttacttgtttaatctagtcttggatgcttatcaaggacatacaaaaaattatcctaatttcatgcattttgcagatgatataatcttgattgaggaatcaagggaagcaattaacattaagcttgaactttggaggcagactttggaaacaaagggttttgcttgagtaggagtaagacaaagtatatgcattgcaattttagcaagagacgagtaatatgactcggaattaaaaattgaataagtcatatcacagctttctaagtttaaatatttgggttcaatcatacaaaatgatggaaaaaatatgaggatgtcatacaagcgggatggcttaaatggagaaaggcattgagagttatttgtgatcacaaagtacctaccaaactcaaagacaagtttcattacacaattatacgtccagttatactatatggcagtgaatgttgggctttaaagggacaacatgagagaaaagtgggagtagcaaaaatgagaatgtaaagattgatgagcagtcatacaagaaagggcaaaatacggaatgactatatacgagaaaagtttggtgtggcaccaaatgaggaaaagatgacaaaaaattggttaagttggtttggaatgtacaaaagggcccacacaaggcgacaattaggagtatattgcatgatttagtctcgtgaaaagggaaagaggaagaccaaaagggacattggaggaagttgtaagaggatctcaggctaaatattattcctaaagcttcggtttttaaccgtgccaaatggtgttatgtgatccatgttgccgatctcatctagtagaggctttgttgttgtttaataaaactataaatcaacactgtgcaccttgcttactttcctcgtccctcaaactagggacttttttttctactgttaggtatggtagaaagtccatctataatctgaaccccttcctcctctaaaccaagccatgctaaaacaaagttaggttgtggaacaatgacaatcatatacatatttatgaaggttaactttgcttgtttgttactttttgatacctatgggacctctcaattttcacatccttgaagtatattccacacaagattagaaagaaaacccatataaatgtagttagaattctggcatctgaatgacattatggttatctaaagatgtgctagtgttccaagaagcttacttatacaacaaataaggcacacagatacaataattaagggaatggagttcggaaaacaaggaatggggcaaaagtataatgaactcaaacatagataattacttatttagtcaatgtcaccccttctattgaataaccacagagcaataatgtccgtgattgaatgtcactgaacactgttctgagaaacaagctttcaaaaatatgcatccacaacttcacctaactatttaaatttaagtaatgggttgaacatagtataaacaaccaattacaattgttccattataatagcaaacttaacaaagaggataaaacattaatcagagatcaatcagataacatttcctcaaaatgcctagtatctagaaaagggcatttgtctaaattattgtaactcttacccctatttggctgcctcttattaacagtgtaaccaccaacataaccaggagaactcttggcagaaacatctgaagctgtgccaccaagtccataaccaaagggactagatccatctctctcagaatttgaagatcgccaagtggggtccccataaactgaactattattgtaaaagtctgcaaaagccccatcaacaccgccatttgatgcagagtatgaagatgttggtgcaaaagtggcaccagtgcttcttccataccctccagtccccaaaccataattgttgtcaccacctccatatcccaggttgccactactttgtgacatattgttccctcctccctgctgcccggaaattgctgaagaactccagttgactccagtgttgccaaatgtgttccctccaacactcccactccctgatccaatgtatgcattggagtttgcagaacttgttccataactaaggccaccattaccccacaaatttcgagtcacagaactgaagaaagaattgttacctccatttccactctcatatccaacaggactgccaaacctattggagctgctgataaaataaggatttactccccgatcatagctaagattgctattgaaatttgcattccctccaaatccagcattcaaaccaggttcaaaattcatgctcattccataacctgatccaaatgaagcaaatccacttcgaccaccggcaacaggactgaatctatcatccgctcgaagtccatagcctgcaactgtacttggagaatacccctgagtgaagccatttaagaaactattgaccctagtaagaccatagttatatccaccgagtggggtgcggcttggtcctggcgataactccttaggaactgctcgcttgacctcaaccattttaccattcaattcatgaaatgtcttaagtaagaccttgtcaactgcctcctcagaatcataagtgataaatccaaagcctctcggcctctgagtgttgtgatcatacataactacaacatctgttatagtcccaaactgatcaaagtacttcttgaaatcactctctgtcactgttgatgctaaacctccaacaaatatctttctagtgcgacctggaccaggagaaccatggatgctgccactgtttctactcagtatgttctgatcatccctaggaacagctttcttagcctcaacctagcaagagaggaaacagtattgagtatttactgtatatcagaaaataaaaaagttttcaagatctgtcaatccttatgacagatgcttagaaaagagaacaataacaaaaatcaaaagattagagaatataaaatatgtggaaaaatttaatgtactcctgctccattttaaaatctagctaagatattttgagattgtgaatataacaacatttcaacatcaaaactgctaccttccaatgttgcataattcaaaaagagaaccttaatgtcaaaatgcaaactttagacttaaaagggggaaacaagaagattaccatccttccgtcaatgctgtgcttctcttttatgactatttctgcaacagctgggtcagaaaaaacaacgaaaccaaatcccctggctctacctgttgtccgatccttcattatcactgcttccacaacttccccataagtactgaaatactccctgagtcgctcttcatttgtgtcccatgatatcccaccgatgaataacttgccattatctgattgcattttatctacaagcaaaagacacgcctcgtccaattagcatttgagttcaaaaacttagaaatgcaagtggcagcagcgtcattagaaatggacaaagccaaccttctaaagcacctaaccatagggtataagaaaaaggcgtgttcctgatggatccaatccaattccttacatatatctataggctatagcaaaattttatttcatttttttaatgactcatagaaaacaagataaaaacaaaatcctggtgtgggatgaaatgcgcacaaatccgggtaggataaaatcaaaaacatgatagcattatcatttaacaaaatgttgaaatacaaatagtccctagcacgaccaaaaaaaaaaaaaaaaaaagcattacaagcaataccataaattaagacaaactgagagactgtattaacgatgcaaaaatagatattgtcggaatcagttacgaaacaacggatccttcatcaacaatcatcaagcagtgaatcaatgaagggaaagcactcctggagaaaacccacaaaaagtttcaagaatcaaagatccaaaggcggacccaattgaacaaagatcaaaacttcaatcaagattccgtcgaaacccaccgattgaagacgagatctgaggggaggcacaatgagattaagaacagagggcaggttcaatatctggctatgcctccccacccttttttttttcttcttttttttcaattattaatttgattaccaaatgcaaattcagttgtcaaaccgattgcaaaattttatgaagaaatcaaaagtacggagagagaaagagagaaacacatcggaagaagtttgtaaggagaaagccgagacgagaaagaagctgcgagatgtggtatgaccattatatagtgcctctgcaaatggaagatgatgattttctttcttcccttttttctatttttcttttttctttccctattattattttttttaccagtttgatttcaaattagtgaagaataaaaatgggaatctagtttttttgcttcttatttttacctgctagttttaaataaaaatcatgttcaaataatttctgagatcattaccaaaaaaataatttctgagatcgttgttcttttgtctgattgttttttgaatttacttagttgcatttattatctaaatctgtatacatcagtaagtattaaaacaattcaattttaatttatataacaatgtactgaaatgggatattaaaaaaaagtcctgtaaattttaaaataaagaatataatgactcataataaaaattaagacatttataatcaagatttgatagtttaaatttatatcataaagatttataagattaaaagtaatttatgaaaatataaaacttgaaaggaaagagaatataatgacttataataaaaattaagacttttataatcgagattttgatagtttaaatttagatcattatgaggatttataagattaaaagtaatttatgaatataaaatttgaaaagatcttatggatttttaacaaatgtttaagattataagagtcaatgaataatataacaaaacaaatataagattttaataaataaaaaattaaacaaatatgattttttaattttttatgtgaatcaatatatttttagaccaaaagtcaatgactaatttttttttgaggtattaagatcctttacataatgaatatctctcaaaagatatttttcatacataaaagttaggaaccaaaccattatcacattgaaataaaattatctaccaatcacatctttaataattaattataattcttttttctttgttgtttctttcttgtgactcccaatttgaattaataatcaagttatttcaaaggagtagttactagttatcatatcaatcaagaaatttaatatcacaagaatacctattaagctaatcaagtaatattttgtaaatatttgtaaataatattattctaaatgataggaagaaagaaatgatcaataattgtattgtcttcagctaaaggaaaatatataatgtgtaatcggagaaagtatggaaaagtctaaagagttcaaatagattattagatgagtgtaacattcaatatcataatatttatactacttgaaaatcttgactaaatactataatatttctttatcataaaaggtcttctaaaatcatttaaaaacacaatcaaatacactcccttttaattgcatttcaatgttcttatgcttttatctttcttttatgatttttatttttccttttttgtgcattcattttcttcttactttattggtgtttatcaacgacaggttatcgacgatcacaaatcctaaaattggaaaatctttggtattgaccaatgataaaatgtattaaaatttgcccatggttgcaaatcataaaaatgaaaaatctttagtattgaccaatggttaaatgtattaaatatgattaagtaaattacttaggttctatttaaataaagttctaaaaaaatatttatagaaaaaataagaaagtaaaatgaattgagttattcctataaactaaaatcaatatgtgtacactttagttttcaaagtagttaaatgaaaatgttactataaaagttaaatgcaccactaactttaatattttttatcgactatgggactaattctcattttgtagtttagttaattcaaagctcattgtccctcccaaaaaatgtattatgtgggaaatacttattttcttatcctgtaaatatttatagcaaaatccaaataagaccttaaaaaaatattaaatcagtaggacattggtccaattgataataaaataaaataaaaatattttttataattagaaattatatgaaatttattattatgcaaacattttagtacgtttattagaccaaatttaaatcatactttacttttatttcttcaagcttaaattttgtattcacttaaatgtatcaggtaacttattaggtcaaagttggtttgttaacttcaagaaaaattcaaatatccataatataaggcttctttttaattattgttttcttatttaatgtgtttttattttcttctacttttattttacaacatgatttttttcatccttcttttttatgtgcaatgtgtttttttctttatttgtgttgactgtcaatcaaaaaagataaagaaaaacaaaatctcttaatactaacaaatagtaaaatgtattaaatttgatgtttttttttttttttacaataatcacactaagatttgatcctataacctcaactcatgcatattattccaaactctcatataggccaaccttcgtggttcttaatgagttaattcacttactcaaaatatattgaataaataagtcatcgatcaaattgcataataaaaatatatataaatgttttacgattaaatttttatattaaaattattaacatgtatgtatcttaaattaatactaaattttaacttttaaaaaattaatactaaatttgaatcatattttttatgcttaaatttgttattcactcaaatatatcaagtaacatattatatcaaacttggtttattagtctttaaagacaaactctaatatacaaaaaatatctcaaaggattgttttttacttttgttttcttattaaatgcattttcattttctttccctttcatctagcaacaagataatttttcttttctttttgtacgcattcatttttattttttttattttttttactgccattgagtggcaaacataaaaatggaaaatgtttgatattaactaatgttgaaatgtattaaatttgattaagccattagttctaagttctttttggataaacttcttgatcaacatgaaaacaaggtaaaatggattgaatttcttttgtcaactacaatcaacttacatactttatttttaaaaaaatttagaccagaggatctctataaaagttaaatacataagataattttatcttaagtctcattcattttatatttttgtatttacttatccttcatagaatcttttaagattgattcccttctctttttttttcttccttttttttcccttcctttttttcaacctcctcgtatctattaatgagttcatctactaccgaccccaattattttgggttaaagatgttgttgatgtaaatgtttatgatgttgacttatcctttatagataaatttatctaaataagattggtcaaaatattgatttagtaagtcaaatgttgcattgtataataaaatatcaaataaaatatttttataattaaaattttgtataatatttttatatcaaatattttagtgtagaccaaatttaaatcataagtaactttatttctttaagcttaaattttttattcattcaaaggtattaagtaactaagtagatcaaagatgatttattagcttaaagaaaattctaatgtccttaatataaggatttttttgtatgtaacctagaaaataaggattcttgttttactattgttttattattgaatacatttttattttattctacttttatcttgcgacaacatgacttttttttcatttttattttctccaatcaatcatttttcttcttctttctttcattgtttgcattgacaatcaatcacaataaaaaaatattctattggtaccagcaaaaatattgaatcatgctttttaagcttaatttttttattcattcaaatatatcaagtaacttttttgatcaaagttctttctctccaccttcctttcttcttctcaactctcttttttctttgttcatagttatttctttctccttcttttttttttttgaaacttcaatgaaggttttcatgccattttttgtgaagtcttaccattcttaagcaaggtgctgtggaaaaaccatctcgcacatccaccaaccaccacaaggtttcttccctgcatccaccaaccaccatgaagtcttttttctagtgtacaccaacaaccataggtctcctctcgacattccatttcccttcgcgtgacctcttctcttgaaactgacataacccacccgcgtaatccgtcaaccgtgttacttgaattcgacaaatttcgaaggtccaaacggttggttgcggttcaacatttgaagtggttgaatttcaacattttaagcattttctgcccgaacccaatcgtgaccaaccgttgcttacccctaatttggaatgaaggaaattttaatcgttctaaataatcaaacaagactataaataataaatattaagatttttttgaatttttatctaatagataaagtgtagaaaatgtacatatcaaatatggagaaaatgtttattgttaaattaatttcttcctggaactcattaacatttaatcaattttacacttcaaaaattaacatcaatccatgaatcagttcataagtacactcaaacttgcattccttgtgtgaaagagcctaattgtccttgtaaaacattaatactttagatgacttaattaaggtacttgctttgagattcaggatcttaagatgactaataaaccatgccttgttcctagcaataaggttcattaggtgttcaactttagttcaaggtttaaagagtgttttccaatacgaatgaaattaaacatcaaaatataaatgatcaaatcatacaaagctttaagcatggaataagaactaatattgaagtgcaaaatcaaattaagttataaatagtacataagagtcaacttagttacatccaaccccaacaaggatgagtttagctcctcttagacacatgtagagccaaaaatgagtaagaaatgaagaagatggatgaaggagtcatgagagagctttcaactaccatacaacatccaaggcaagtccatgtgagaattaggtcaaagtgttttgttaagagacacattatttctcatcttgttctcattaagtgacatgtcatcgtgtttcatttagcaatataaatattacatctatagaagtattctttttaggaagtacttgctaagcgagttttgatcaagctatttaaaattttctgttcactacaagaaacatgcatatttatgaaatgccttttcatcttctgcttttatcatgcaataacatgatttttttttattttgcttttttaatccattcatttttcttctcctttccgtaaaatgaataattaaatatgtattaattatttaaatttaatatgttaagaaaaatgcataatccattaattaaattaaatataaacacactcttacagtcttactcattttaaaaaatgttaaaacgagaagagtcttatccaaattacatatacatcaagctcagcatgcatgttggaaaagactacgacaacgtggtgaaggataaaacgaattaacagtggagtttgataatttgagaatagtgcaaaaaaaaaaaaaaattatagtgaaatgttgttggtaaccttaaactcgaagaagtagatgatgggatggacatatataacgatgcagcagaaatggtagatattgatatggcggtggtaaatttaattattgaacagagttgggtcggagcacgatcctgtgtcacgtggaggatgaaggaaaacacatgtacacttttctcaagtgtttttagtattaattcttaattaaaattcaaaattcatttccataattagtattcactttttaatattaccaatggatcttggttgaggcttgttccatttttacgaataaaaaaactttaatattgacttttagtatttattttttatacactatcatgtaaaaaaaatattgttagtcaattaaaattactctaaataaatttattaaagtaattattataaaattattggctaaaatgggagctctatctcaagatcgtctcacgatttctgattttcctccatcagaaatcaccacgttattgttagctgatttagtgggagtagctttcacaaggatgtagttttttatttttaataatttgtgctcctttttccttttactacaaaaaaaaaataactcaataatcttactgtacatgataatttattattaaataaaatatcaattttttatactatcaatatattttaattattagatgaatataaaatcaattttaatatttttttaaattcaattttaatgttttaaaattcaataactaaaaataaatttatattataattttaaaatataattgttatattaaacgttcacttatgaaaaattaattatataaaattaaatatttattgagtacagtgtataagttaaaatgctagttaaattttaaaaatattgtaagtaatttgggtagaataattaacattatttcttctcaatttccagttttcaataaccattacctctttttttttttttttccctttccttttcattcctttattaacgtgactagtgagacataaaataccaacaaagaaaaaagtgaggcataaattaagaaaacccaaacaagtactattttcttatgctagctggagacattaaaagttttttgaactatataataaaaaggaacttaatccgaatatgttccctcccaaatgaaacagatttttaagataaaataaaatttatcctttactcaaaataaaataaaatgatattttcccctattgaaaaaaaaaaatgacttgatttttttaaaacagaaaatgaagtgatttaaataatatgttttacctgcctcgttttttcattatattatttgggatatatataatgagaacaacatttatattaaaagtatgagaattataaatattgatcataccaccatacaaaaacaattaagataaaaaatttgtataaaataattcaaatgttaatagttacatgacatttaaaaggatacatgcgtttattatttaatcgttaaccatttaggtaagacttaatgatacatattcattattttgatttcccaaataattataatattcagtcaaaaaaataattataatattctcacctgagccgtttttcagttatcttgtgaaaaaaatatggcaatgataaaatctagcaaagatacaagatatatgcattaaatttccttgctttgcattgccaaatctgttgtcatttagaaaaggctaaataatatgctcttagttctttacgttatctataatatttaatttagttatttatttttttaaaaagtttaatgtaatcatttacgtttttaaaatgagtttaaacgatttttttttaaataatgatcttttatttattttaggacatgatttaattttttttaactaattggagacttaaaatttgtctcgttaaattaacttccatgaaattatgaaacacaattgatccaactgaatataatctaaaacataaacaatgtatatttcagcttcgagaaagaagaaaaaaaaggacaataaaggcagtgcgaacgttcccctgcaattgtctagttgactttcttgtaatacaaaaggatgatatttttgtagagtgaaaagatgatatcatttcatatatgctaatcacagttcacacgtcataaggatttttttttcgcctatagattcaaaagataataagttgcagtgatcaaaataaacggtggccaccaattgagattataatatttgtaaggaggacttaacctgtaaatcacaaggaatctgtctcgtacaccaagaatataagaatatctaataaacaaaaaaagaaattgagattaccttaaagcgagaaaactcacaaaaagtattcagcattaaaaaaaatgcgtagaatgtagcctttatttgtttgatgcctgtgttttcggttcaattatgaagcttgcaaggtggaacaatagaaaggaactattcttccaaaagttacaagtccatcattggttacccttgccatcgactgacatgttagagagatagcattgactatataattaagggtaaggaggtccgacttaagggtaatattatataacaaaaaaaatctcaaaaagggattaataaattggttgggccaaatatgggagttactgaaagtacactatgaatgaagtttggtgtttttaactttttggctataatgcagtaattaatgcaccgtttcataatgaagtgatatttatggttctataatgtttacccattgtactctaactacgagtgttttctattcagttatgctaatttagctttgtttatgaactgtgcagataagtcactgtgaatcttagtaaacaaatgctcatcttactggtgggtgattaaaccattcaggagaagcttttggttcagtgcttcacatcacaccaattgttgatactgtaactaagttgacagccagtagtgaattatgttacaaatgtgccttctttactttgaggaagacaaaaagacagacaaaactgattagtgggttgatgtctgcatgcctgtcaatgtcagccaccatcactatgccattgtccaagatgcaaatcatgcaatggagctgcaagttttgtggaatttcacatggcctagttatatatatatttatatatatatatatatatatatatatatatataatagcagagtttcttcatgatcctatcatgtcaagttaaaccaatagtgttttgtactcaaatatgacaagttgaagccatctgaaccccaatcttttttgtcagctcttcaatgttcaatatctacaaccttatcctttatataattttaatggacatatatgttatgaatgttaatgaagtatattagcctattaaatggccattaacattttctttcttttgttccttttcattctttctttctctcaccccctcttttcctgtttacttattattttcaatgaaatgtgataaaaggaaaaagagaattgagtctccaactctacgtggttctatttgtatccatattcatacacatcaatagtaaagttcttatgctacaattacttggacaattgactaggagttcccggttttctcttcagtttccgacttccagacaaagttatgcggcgaaagaccttgagtagcctgtttgcataccttctttgtgaagcaaagtttacagaactgatgcaactagtcgcttgtccaattgggttgctccttttgctcagtgatcgagtttctaagccacacggcttcatcttctggcttttgatcaaatttggttctgcttttgtaacaatgttgtgcaatttaaggctttttttcaaggacatgagttcttgttcaagattttggattctgaagcttgttgactcatattccgtagttgagaacttgaaattctgcatcacattgtctttctgcagcaggaagctcaatggcctgctactgagctcaggtccatcagtggatgggctctttcctagattctgacttgcagaatatggatacctagagcttgataggcttcctgacatgtctccacaatgtgcatatctaaatgaatctgagcattctttgaaggctttgtgtgtattgagttgttgaacaaaaagtgcttggacaattagacgtagaggcatcaattcgtcttgaacagcttcaatgcatgcctcttgtgataacctttgacagtccagatacttgcacacggctcccttatcatcttgggaaatacctgaatgtgtctacaataaataaataaaaagaaagaaaaaagcgaaatatgttaaagctgaaattgtattgttcttttttaatgattggtctttgacataagttgggaaatgagctatgatcaacttttgctaagcttgtaaatagtatttactcattatttctcttattctaaggaccatgattattgtatcattcttgttaattattcagttagaccactaggtagaatgctgaacattcattatagtgttcagttcctaaacggatagtattattggcatgagagcatgtgtaatcaactaatgtagtttaattgatgagtcctactttttaagaagcttttgaggaatgctgaatgcttgcttaccttgagaaagctgttgattgttttgtaaagggggtaatgattctgtctataagatggtggtaccctttcaatgagttccatgaatctctttggtcccatatctggatctgcagctattttgaataaatatgcatcccacaactccgcaaccctgtaattgctagcttctggggtatggtttacacgtgagctagatgctacatatgctgaaattatgctttccatagtcaccaactccatgctagaggacattaactctgctccactttctggaagaagaaaatcctccacttgagaaaagtgcaaaagtgatgtaatttggtcttgtaactttgccttgctttcagtcctcaaccccaactcaagagatctagaaagcaaggcaaaataaaaccccactggaatcactttcctagccttatcacccactggaagaagatcaacaacaccttgtagaatcacagaagctttgctattcatgccaccctccccaatcttgtcacaggaactctcccaaaattgacgcgtctttttagagagcacccatttgtttgcatagaaaacaatgatgggactcacatacttctccttcattccttgtttcctcaaagaccctataacccttttgaaaaagccaaagggtagagcaatcagatccctcatccacgggtcttggctcacagcatcatccttcattatttcacagctccaatctttggaagccaactcttccactgtcacaacaggagtgtctctccttctttctggatcaagcacctccatgcatgccatgaaggcaagagattcaatgcagcgactcactattaacagatcttcagaccaaggaagcagcatctggcacctttgaagtgcaataagggtgtcatcccaactttgcaacacaacttgattcagataaagatcaaaccgttcacaaaggttgcccgaacagtgatcttcagtcatttcaagaaactctgctgcacacctaagggccacaacgttaaaagggtcaatcaatgtggaggatccataaacgaacatggcaatcatctcaaaggtttctggtcctccagggaatgtttccggaagctcaacctcagacgcattgtttaacctcttcttgaagtatccactctttgaagtcaaaggaaactgcaataaacacaaaatgcaaatcaataattaaggtagttactggtaagctatgtgaaacattcttggattccaattgtgtctaaacttactttatgcaggttgaatatcttgtctttaactcgaacacggacagaaacaggtaaacctgtttgttggctcctgtgacaaaatatcgaagtgcatgagataaacttcggacatataaccacacgtggaaatggaatgaatgatcaatgacatgtatatattaccatgtgatgaccttgatcttgagcaaggctccaatgttaggtgaagagtaaggactagaagcaacagaataatcttttggactcacaacctccatgttagtgctacttctgacaatggaaggatgctacttattctaactgtgactaaacgaatgcatatgattctgaatccttatctggtaaggaattaactagagcagcagagttctgatgttaaagaaagaaaagtagtgtggtgaagtgagatttgaggagtttgtccccaacatattcttgctggatttgtactattattcaccttgcagtagtcaaagtcaacatgcacacgagtgaaactcgaactccaaactttaaggcttcaaaaacgttctcgaatgttgggtacttgaattcttgggctacaacttggcggcctcggccaatagaatagggtgacttttcatgcatcctaacatctcaatattgcactttaagtttgtgtatgtacaaccataaaaccctactcctaaaattcatgagtattatgttaaccagccatcaaattaattagttaatacttagtggatgaatcaattggtatgaaactatttcagtttgataaattatttcgaattttagttttatatatgtaactatattaaatattatttaaagaaaaaatattgacacttataatgatattttttttttgtcattgaaaatcaaataaagtataggagatttataacacttacatatatatcttatttaattaagagaattagacccccttagttctacaattgtattactaaactaacataggatacccaataacctatactagaaaattagttaatattttattaaatatttttaattatttaaaaatatgtgttttgcatttttaacttttttttttgtttatttgcttaattagtgtcattgtaataattttagtcttttagtataacgtatccaacggctgaaactttcagtctcgattgtctttgtcaacgtatagggccttaattgatggctgatgaggcatttggggaaatgatgggaccaaacagtttacacaaagttacgttggatttggtttaggttttcataaaagaacaatttgggtgtattgggaaaaaagaaatgcaagggtatgaaatgaaataaataggcaattgaggaaatgataggattaaaatattgcaaaggaaaagaagatggtgaagtgcatgtgaagttttgtggttcctttatgtgccgtatgcctaacgcccaagacggcacggctactcaaattggggtgctttggttattgggttttgcttcctttcaaccacggacccctggatccaatattttacttttccccactctttgaaaagtacatgatgcgttgcaaaattgaatttctttttttggattttatcttatttagtaatagcatgatttatgttgtgtttataaatttatatttatattgtagaatatttgagtaaacatgtaattctaaaatttgtaaagtccattgtagcctttcttcatgattcttgatcgtttacatatatgtgtgcattctcatttttcagatacatgttcaatgattaaacatacgatacgacttctacttagactggttaatatctctcagtgattgaagattttgattgtttctgtcaagtgggttaataatgtacttatcttccacttgtttggttaaatatattggtttgcatttgttatgtggttaaacaatgattgtgacttctacttagtagttgagctttccttagttgtcattattgttcacttgtgtatttgcttatatatgagttcaacatcttctcaattcctaaattgtttttttaagaaaaatgtgaattttattaaactattatttattattgcaagtcacgaaagagatacataagtacgagatacaatttttttaaaaaaaatgatgcacgaaattaacaatcttcctagacccttatacatccattatagaagggaaagtttctatacatcacaagactccaccgacagggaaacaatgagcaccaacaattatgatatcgaattcagacaaagcaaggggttagaaatccattcaaaaaaaggaaaaggatgctcgtggcttcttagcacctgttgtatacacggttctgcctctctaaaaattacatgattcctatgagttcagatagaccatagaacaggcatccaaattcccatccagcacaaatggtccatattccctctacaaagcccatggtgactccaaaggtaagcaacacagattgtagggagagcttgttgtaggccaagccagccataacagctttgccacaccttgtatgagaaggagtaagaaaaaacaaatgaaatgcagattcagtctcagcattacacagtttacataacaatccttcctcagccacacctatattccttctcaacaaagcttccttggattgaattttgtctagtgtcacacgccacctaaacacaagcacctttgatggtgcttttaccttccacaaagcattaaaaaaacttgagtggtcatcaatcatcaagttttgaattagtgtatatgctccctttatcgaatatccctccgagggtaatactctccacaccaccagtccttttcggtttccaaatttgtaatagctgcagcagttcttcttccatagggatttcccattccataaagggaccaggaccaaaccacttacacaaaagagctttgttgaatgtttatataagcagacaatcaaagagattggtctgtaatcccccagaccttgtggagtctcctttttggggatgagcgcaagaaatgacgcattagcaccaactgaaaagcgaccatatctacagaattctgccatgaccctcataatgtccgagttaagagtatcccggaagtgcctaacgaatttgaaaataaatccgtcaggacccaggcttttgctcccctcacagtcccaaatcgctgccttgacttcctctttcgaaaagcttgcaatcagaccaacactatatttgatcatcaagtgttggaacctatcatatgaagacaaataactattatacctctccttaacaaagtctttgaaccctataaccatccattctccttaacaaagtctttgcagatttgaggtgaactcaccattctcccctctcttctttcttccgtccttcttactgcgttattttggtttgtattatttatctcatgccgtaaatgttaataaacaactaccaacttgggagggtgttggatatatatagctagaattagaaagttgttagttgggttaaaatgatgatttagattagttactatctcatccttgcatataaatgcaactagaaagtgacccgtagatagagaaaatgagaaagagattgaataaaaataaatgagctcatacacaaaatggggatacaaggcgatgcttgcatggtttttatagtgcaaagtgcaaaccaatgatttacttgtaattgatatattttaattctaacatttttcttgtactcgagaaatacttgaattaccttatgcataattatcatacaaaaaataaacagttaactaaattagtaaaagaaagttacaatcaatcaaagtagtaaaagttcaatcctttataacgcagaaaaaaaaaaaagtctcaacatagatgtttcttaatcaccatcctaagactagaaatcacatgcctctcacgagtcttctagttaaatgaagggaatcttgtgttctctaaattaaacaaaaaacaaaagttacatatatacatttttatattattagttattaattacttttataattaattttgtcaaatacttttaattcaataagtttatttataaattttcagctttaaactagattttaattttaaattagctaataagatggttttgccaaacataataactaacaaagttttcttttcgtacattttagtaattaaactctaactgtaacataatttatcaccaatattttacatatatttttgcagaagctacccatcattttattataatttcttaatgacattcggcttccggattttgcgatacgtaaccttctattaaaaaaatatgtatcgtttttgcacgtgtgattcttatgctgtacgttttttataccgtaatggctttttttattttttataattgagtcttacatcaagaggctggctacaaaatccacaggaatttgatgcagctctattagttttctattcgtagaattcaagtaatcatttatcgaagttgccaatacatatgcagatgtggaatttctaataggattattaccgacttaccgtcacgcatttttttttgtgagcatttatggtcatgcatttactgtattatctgttatattttcatttcattttttcttcttgtctctttagagcatgtttgattaacggttcaaaaattatttttgggtgctaagcttacttttgaagaataactcagtttcataatatgtttgattagtttcaaaaatatgattgcattaaaattttgcttagaaattaagttttgtaataacaagctaagacttgacttgagttgtttctgtaaacttaaatttaactcaaatttaatcttacaaattttaatcgaaatataacttacttattttttttctattgtatgcgtttgatacatttttctccattttttttttatctctcttctttcttctttctgtttatacactctattttttagatatatgtttgataatatttatattttttttatattggttatataatatttatatcctcattgatataaatataaaataatctctctatttgtaagtttggtacttctggtatcgatcgatttccattaatacaactgctttgatgattttataaaagaaaaatacgtttgatatttttcttttctaatatagtaatatacatctcttagacagtgaaccattgacacgccgcctaaggaaggctttatcatttgcatttgcaactagtaaactaccaaggaatacgaatatgatgctgttgccaaatctttgtagcagatttgtgcttcttaatgtcaacactgcgaaattctcttaattttttgttttttaatggagggatctttaaatttaaagaagaaaaaaagcatgctttgaatactgtagaggttactaatatatgtcttctcttctcttgtttttacttttttttctttttctttttaaagctcacttatttcattggaaaatgaaaatttcaaacaattcatctacttatagcaaaattagggataacagcaatcaaacgcgagtttgcttactttcagtcttgtccctcaaaaggcgggacaagttcgttttgagtttataaaagatgaggtgaaaaatgaaattcaatcctattcttccctagattttatcatgttcaaaaaaaattataaaaaatctatctcacattttttttaaattatttgttcatatactttaaataaattataaattaaattattaattacatttcaattcaatatatatatatatatatataatttaataaaaaataaataacataaacatatttaagttaaattatattttaattaaatgtataattttaaattttattataattagtattataattataatattatttatttaactattaaaataattattctatattttaataattataaaaataaaacatgaaataattatataattaacaattacatataatatataattatagaattatatataaatatgtaactacactattaataattataaaaatataagtaatattcctaatcccacttccttgggaaatccgaactctacctgggtcccaattaatatgggtttttcacgtaaaactcatggcggagtcgaatagatataggttggatttttattgacatacctaagcaaaatgcaactatttgaaaagatggatttattagttgttgaatacacaaagaaagagcgttcgtatattttctaattcatagcaatatgattgtagaacataactaatgtaatacaaactttgatttaagtttttgtaagaaaaaaacttttatttcagtgtattttcatacaagaaatatcactaacacgttatattatataatctgataaaaaaaatcatataatatttttaaaaactcaatattattatctgaaattttttaactaattaatgaaatgaagtgatgatgagtttaattaacttctaatttaataccaacatatgtgacttggaattggcggaatgaactcattcttcacaatgtgacaaactaaaatttaaatcctcgttaagagaaatgactacatttaatttttcatcatgtcttaagtataatgcttttgaaaaaggatattgtgagaaaaaagcttataatttaataacttttactcataaatttatgagttttaatttcagtaaataatttattaaaaagtatgattttacttttctttctatatttttatgctttttatttattatttaattcatcaaatactcgttgaaatttgtagagcctattttatatgtagtattgctgctgcttagttcaaaggaaataatgtctcgatttatttaacgagtaaagtagaagttattcatttcaggaaatgataaataaggagcaagcaggagctagagaaaacgaataaaaatgatatatttttgataagtttattatggttatagaaaacgaatatacttttttattttattttataaaaatgggctacatataagtaacaaatacttctatccaaaatgacaaaataaatgattgtgattctagacatgattagaaaatatgacatgattgattagtttgctatgtaaatttaaagaaaagtttttcacctattaaatggcgtagtttaattttaaaaaagtatataaaagatagaaacaatattattattaaaatatgatgaaattgtgcatttaagaaagtttttctttcttgtcatattttctattaaatctcacatgttttcaagatgaatacacttctcaaaattcaactgaaaatgaaaccatgaattacttgctaattaagaaaactgtcattaacctataatcttaaatcaacctatatatatatctatagaacgaccatccattataacttattcatcctaatatcgcggaccaaaaacaaaacttattcatcctatcacatgttagtttttagttttggggcttaaaaaacatagtatgctaacctgtttggtctattgggtcgggtcaatttgaccttgttgtttctgaacctcaaaataaaaagcccatcggcctaacccattgggccgggctaattttgaaagctcactttaggtggacagataagaatgtagttgcagagataagcatctaaatttgatagttaatcttaagcttgttggtttcagctcaagagatgatgcaaccaattttaaggaagccctcccaagtcctaacggtttcactgttgaagcaagtaaaacagaatatgccagaaataaatgagggaagcagctggaaaacaagtggattggcattttctccaaacagtgtcatctattgttcagtccactgcggaagttatgtacatcactgatatagtgaaactggagtgaaatgcatgtactgaccaacaattagttgtggcctgtgggatacgaatatacttggaacttggaagtaaaaagtagttggacataagggtcaaacaatgaactctgaatacgtgtgaatgaaggtattcaattgattggcgttgattcttcatcattgttgagttcataaaagaaaggatcctcaaggagatctgtggctgaaggtcttgcccttggctgtgctatgcacttctcaatgaattccttcacctcaggatctgtgactttgctcaaggcctcaggcttgattcccatcgtgacctttttgtatatctcggccacaccgtcacattcactgtagggtatttccattgttaccatttccagcaaacacattccaaaagagtatatgtccaccatctcagtgtaatcttcctcgtacagttcgggtgccatgtactctggtgtccctaagattgaatgtgctgcatggttacgtcccactattgcagccaatccaagatcaccaattttcacctacaaaatgccaaggtcaaaaatcaagggtctatttatttccattcacttttttggttttataaactgttttctaaaacaattccacattatttagtaatccacttctcatccaaattttgaaaattatttccaaattaccagaaagcagaaataattaagagatgtttttcaaactcttcttcaattctacactctctttttgccttgcatcaccctccatcaactatatgagtgaccttgtttaattccattttcgaaaactaaaaacaaattttggaaatagtaactaaatacaccttaagttttcaaaatgcaacctagcaatgcaaaacatagcttatgcataagcaaatttgtaatttgtagaagctctcttctcttagcttctccaacaactgatttttaggttatgcataactgcataagctaattcatcgtgtaacaaaactgcattttctttgaaccacctaatcattgcttaaaaagaagagaactgcatatatatgttggcatgactgtgttttcgtttcttcatcaatcatcaatagcatgagaaatactaattaataaaaacaaagcaattattaacctggccaatgttgccgttgacaaagatgttgctgcaattgaggtccctgtgaatgatgcaggggtcatgcgtatgaagatactccaatcccttaaggacctgtttggaccatttcttgaaggccttaatggagacgtggcggtgcttcttgcggtaatccctgaggttcccggaggtgcagacctcagtgatgaaattgatattgtggcgctcctcgtccttccacacgctgtaacagacgatgatgtacttgttgctgagggttctgagcaactcaacttcagagtgaaggcgattgatgagagcagtgtcttcgctgaagttcctcagccgaacctgattccacgccacctcgattccttcctcctgatcaaacgctctgtataccttcttcactgctccgcaaccaagaagatccctgtaacgcccgaacctccccgttggatcaacctccacgaacgcttccacttcgctatcgcaactgttcgacttctctgcaggcattttcaatctctctctctggtggtaaaaggagaaggaaggaagggaaaaggtggtgaattcgattacctcgctaacaactaacagcttaactaaactaactgaaaaggaatttatgaaactgaattaatatattactgattactcgttcaataattttctataaccctactttttcgctctgtgtcggttcattatcacatcaatgatcttaacttgtagtatttttttttgtccaatttctgatatgattgtgcatgaagcagcaagtacaatagtgaaaatctatgcgtaagaagaaaagcttattaccttaacaggtggcgaacggagattgggaatctgagacctcaaatatttgagaccctacgcggaagtgtagagaataaataagcaagggaagggaagggagattgagttgttgaatgagatggcaaatgttgaggtacacacacaatctccttttccgtttacttttttttagtttttaactttgtgttaaaaatcaatatatatatatatatatatatatacatgaattgaaataataattcttcattcattttcattcattttattcattcctctcttctttctttcatatattttcccttaacatgaggtttttatatatataagagcaattcaacaacatcctaataatacggaataataacaaactgatctaatcttaatttttatttgaatataataataaaaaaatgtaacaacctaacaaattataataataacttgaaatttaaataatacaattcaacactcccctcaagttggtgcatgaatatcggtcatgctcaacttgtcaattgcttcttcaaacactctttaaggaatgactttaatcagcaatagtttcaagaagtgcttcaagatagttcacaatgtgcttcggttatgtgaggtagaaagaaaattgagatacggaaagagattcggaacaataacatgttcatgtcaatagacttcagggatggtctgtgaaggattcagaacaatgcaacgagcttcacatcaatgaccttcaaatggaatacgtgcatggagaattgaaatacgagaaaggattcggaacaatcacatgatcatgtcaatagacttcagggttggtatgtgaatgattcaaaacaatgcaactgacttcacatcaatgaccttcaaatggatacaagaatgattcaaaatggaaccaaaatcgcaaaggttatgcaaggcaaaaatgaaattcatgataataataatcataatttgtaaaggaatcggaaaaggtgaaggttaaggaggagatagatggttggatataagtgaaatacattgaagataagataaaaagatagaaggagatgtacgtttgggattgtgaagaagaaagactctgaacaaataaggcatcggaaatatggtggatatcatgattctcattcatggaggaaaccatgattttttttcatggaggatatcataactctcattcatggagggaaccatggctctgataccatgttaaaaatcagatatgcatatattggaataataattcttcattcatttcattcatttctcccttctctctttcatatattttcgctcaacatgagatttttacatatataagagcaattcaacaacatcctaataatacggaataataagatctaattttaattcctatttaaatataataataaaaaaattgtaacaacctaacaaatcctaataataatttgaaatttaaattatacaattcaacactttgtagtaatacatttgagatccttgccatgacgcaaaattgtaatgtaatgggaatcattggatctggattctgaacttgtttgttacgttcacgggaagaatggcaaaacatttaagtttcaggcaaagcccgtacccatgctcaaccaccattaccaacagtctctcttactgtattatctgaaatctgaattttccaatattttcttcaacaaccccaccccttaatcatgatacttccaattaaataccattttccctatgcaaagtgtacaaaaactactggtgtaatcttcagcgattctgttttttcaattattcaaaagctggtttagttacgttattttcgttgtctcttcatgcatgagttatggcacgcggtacctgtacgttatggctctaataaaaggctatatttttgggggggcgggggggtgtcaattgacatgaaaattgcatcaatctgttcaacagctatatcaccttgatgacgacatgtctaattgtcaaatgctttaatctgaaacgtttagatccattgaaattcttctcctttttattatagtgcaacattgtagtcttgtgagtttatcagggcgtgcttgttaatacttttgaaagactacgcacccacaaacaacgtaaaaataaacaagcaactcagatgagttgatcaatagagcttatcttttcggcaacaataaccacaaacgagtaattgatttgtcaatggactacaccgtaggcctttcaacaacaccacctttttcatgatactttcaaataaactgctcgcaaataccattagtcctatgcgtactgtaactattggtgtagcctttagcaaaaattaaaaattggtgtgaatatgattattacgtcattatcgtttcattgttgattctgtggcatacccctgccggcgctgctattatatggctctaatatgatttatcagggatcaattgacaaagatgtacatcaacgtatttgacaagctacagcaacttgctgatgacgacatgtctaataggcaaatgcttcaattcgaaatatttagattcattgaaatcttgttctgtttctggtccatgttaccacaagtaatccccagtgaatgtcttgcgagtctctcatggtgtgtttaaagtttaatgcttttggaagactacaaccacaatcccgcaaactacatataaggataaatcaatggggactatcttttcagcaacaatgaccacgaccaagtaactgactggttcagtggaacacacctcaggcctctctcagaatcaatggctcccatgggtttctttaccaaacaaacttgtcccttcaccattgtaaaacacccctaatctaggacgtcttccccctactatggaaacacccttccctttgtactattaatcgtttattttatttggagcaagtaaatgcaattgaagaactgaaaagggatctgtacaatgtacatacatcacatgcaggctcaattcttgcacgactataacctttatctgataattactctaaaaggccataccataaaaataagcatcaaactgccattcactcagatgcatgtgagatttggctacatgaatggcaactgcaaaatgtatggtgaaaccagaaagaacctacttttttatgcaaaaaagaaacgtgaagaaactattcaataagaacaaaacctatcacatagacgcataaaaaatctctcaaataggcagaaaagtgagatagtaacttcgtagttaatccaatatacaacaatgcctttggcatagaggaattgactgaagaacttctagcaagaagattttgcacatagacaaccagtaatcgctgagcaaggctaaaactacaagaattaacaatctaagttgaggttacaaaattcagcaagcaaagtttattattattctcagattttttttctctccaaatttatatggcggtgcaactttaatacatcatcaagggggagggggagacatacagcatatcatggtttcaaaatatgttacaacatatcacaagggaggattggagccctctctaacagatggagacctggaagccaagctcccatcacgaccaaaccttgacacactcctactaacacttctaggagtagccaaagcaggagtagaaccacggtaacttgcccgaagtgtttcatcaacagaagatgaggacttggcaaacgcattcctcacaaacttctgagctgcaggagacagtgtacgcatgcttggactggcactcccccctctaaccggtgatgccaacgggggcttatgaaacatttttgacctctcccgtatcttgcgtgcagcctccctagaaagagaatgtgcctttgaatctcttgccggtgcagaaggaatcttataatgaggaccatcagcactaccaccaatatcaagtggcgtatcttccagatccaacctcagcggagtcccctcaatttctccccaagtaataaacggggattcatcaacacctggagcaggggacggtgtcttaacaaagctataaccattctcagctttcttcccagattctaaataaaacggatttggagtcttcctcaaatcatccaaatcatacttctttaacttatccccttctctaagagacataggcgccggcgtagtgccagcaactggcgcataaagcacctcaacagttccatcatcttttggcctagaatccatcattttaccatgaaacctagtgttcccgcgattgatctccttcgtggcggctttaattctattcgctctttcctcctcggtcaaagggacctcaccccgatcagcaggatgatacattaacaaattcttggcagtgtaattccacccttcaagggtactcggaggctgataagaggttccataaccatcagtaatcctatccctcttcacatcctcaataccctgcacatcctcattcaaatacccaaacctctctttcctcttcttattcactttctctagaatcttcgaaaaactatgattgtcctcactcgtgtacctcctcataaattgatcgaggccaagcgaagtatcagccccaccatcgttattctccccctctttagcctcgagaaccggggcacgggggctttgagagggttttccgtcgaactcatcgagaggtgtgaaatttctaacgaatgtggaaccgggtgtgtgggaggttgttctagaagtatcattgggattggttacctttgctgtgccggcgcggcgttcgaggatcttcaattgggcctcgcgaatgacaacagggtcgccggttttgatggcttcgagccagtcgaggcggtcgcggagcttggagatgtcggggaagtagtcgcgctcgatgatcttctccaacgcctcaacgtacgtgtcctcgtccagcaccgcagggtgcttcgcacacgatgatgatggtggatcgttagggttttgcgccgatacctgggaaattgaaggggacggcgacgagatgtggagcggcgagtgccctggagattgaagcattttctcagggtgaagagaaagattgattgattgaatttgtgtgatcaaaactcaaatctgtgagttagggttagggtttgatggggagaagattctctttcaggttcaacacgaaaacaaagcgagattggaacatggaacagattttctcccaaaccgtgttttttcgttttataaataagtatttatcttttttatcttcacaataaaagtaagtttttatataaaattttatttttttcctaaatacacgtttctttatataattaatattttaggtaattttttagttatttattttttaaaataaaataaagatagtgacgatctttaaccgtcatagtataaaattaattattttaaaagatttaatatcatttttgatctattatgtttcacagttattttactttgatatattaagttttaaaatttttattttggtcttttatgttttcgaaatatatcattatgttcatttttaaaatttaaaagttaacaaaatattaaggtttcgatgattttgttggtaaagttcaaagccgcagtatctatttcactcaggattgagtttctttattaggtgtttttttttttgcctgttatttcgggaggtattcaggtttggcatatgcatgcatgctctgaccaagatttttgggaatgattctgtactccaatttggtgaaggagctttacaatttgaaaacataaaaaattatgatgaaaattttaaaacttaatatatcaaaatgaaataattgtgaaacataataaattaaaagttacattaagaaaaaaaattaattgtgtaggtcaaataaaaaaaagagagtatatttttatatgatatgataagcccaatggtgaatgtagctcagagtgagaaaaaaaagggaggcccaaatccaaattgtgggttaatagagaaaaaataagaaccaccgaacgaagacttgacaaatgaaatgaaagcacagaaaggcatattttgtgtgtgtttgtgtcagcgtgtcactttaaaattaataataaactgaggagagagagaggacttttgttcccctttgccttgatttttgggtcaaataaatgaggatgttacattggactctctcccattgcttccttccacccaaacccacaacatagacgacatcttctgcaacacaaccaaaataccctcccttgttttgtttactcaactcgcacttcctcttcaccaattttgaggtctcaattccgggtaagtaatgcttcccacgtgctatctttctccttttatatattccattcaatttcgcctacttcaattcttccttcttcttcttcttttttttaaattctccccttattttaatcttcatatactaaaatctgtgtgggtctttttttctttctaaccgaggtatgaactgttgtgggggtttggggatgcttccacagaaggtggaatagcattttttttttgagacctaagcaatgaaatcctccccctctctctctttcctctggatttggttcggctaatttcagatacaaattaaagaataagctatctctgtaactgttgtgtttgtaattaattggattattcaactagtaattaagacgttaagtactgtatggtaaaagtgatctcaaagtaggagctggatattgatttttgtttgagatttgagctcctttctatctgaaaattaattaacatggctttatgcatgtgtctgtttgtatatagtattgcgttaagactccgatttggaatatgtatgtagatattctatttggtccatcatggctgaaatggtttcacatgtttaaagtgagttttatcttgcggcttctactaataaaagtttggtttttttaagatcagctgttgagcgactaaaagtagaaagagagtttttacaataactacttttttattccaatataaactttccacattttgttccttagaacagggttgacattaacaaaactgctaaaagttcaataaaggaaccacgtatgaaaagaaaattttctcgacccacactattcatattcatgatattgctgtcacagggcaccgaaatttgtgttttgctaattgctttttaaacgtgtcagctttgaacagccacaagcacgcattgcttgttcaaggttcaagccattcatggaagcagttaatgaaactagacctgtttccttctgatatattagaaaaaggttcacatggtttctacagacaaaagtgcggatcaaaatatcccttctgatcaattgcagcagagagtgagtcctgatagtgatacgacattgtcacaaggtcatgatactaaaaatgatctgtccaaaccagaggaagcaacaagtattctttctattgtagttaaaaatgaagggaaggattctgatgctactgcttgtgccttggaatcagatcaagaaggaagcacatgctctttaccacttgggaaacctttgcagagccctgatactctttcgcatgaattgcctcgatcgcagtccagtcaggaatgtccctctataatacgtgaaaaggtatcaaaagatggctataactggcgaaaatatggtcagaaacatgttaaggggaatgaatttataaggagctattacaagtgtacacatccaaactgccaggcaaaaaaacaattgcagcagtcaaataatggacatatcacggattccatttgtatcggtcagcataatcatcctagacctcaattaaacacagtatcaattgagtgtgttctgcctgttgttgaacaagcacttcacaaaccctctctagccaatgtggaaggtgagcagtacactttgtctgtacttttgtttctatgcctctgtaggaaagatcttaatgtattttttgacatcatacatgaagacaaagcatccgttgagcatggatgtatgcctcaacagatcaagcctttacaatcctttcctcctgcaacagtttccccagttaatgagttgaaagctgcacatttacaattgactaaggcaaagaatctggttcatgataacaaggaacctgagtcaaagcggctgtacgttatatcactattttttaaaatttgtgttgatatatatatgcgatagctaacctttactgccaaattgataccaagcaggaagaaagacaatagtaatgctgatgtcactagagttgacatgtcaactcgggaatctcgtgttgttgttgttcagacttcaagtgaggttgatctggtaaatgacgggtatcgctggcgcaaatatgggcagaagctagttaaagggaatacaaacccaaggtacatgttaacttttcatttcaaaatgcagtcctattttctgctggtgttgtgtgtgttagaatgtgtttatattgatccatattatatcattctgccttggaagagctagcctgaagccctgtgagttgtgactataaattaatttcattagcttccagtctaaagatctgtttgagttattcttcgccttcttgaaaccaacaggaagtgattatagtatttccttttatatcattttcaaagtgtgtcccacatgcacgttttgtaggattataatctgtggctaatacttaagtccgcacaactaggtcacactttttatgggtttaacaatgatttagcagttctaaccaggtattgaaatgcaacccaaactcacaaatgtttgaacatagatgaacaattttattagaagtattgtgtttctttagcattttaaaaaagcaaggcaattgtatcaataatgcttttgttctgaactggtatattcactatattgggtatctgccaatgaccgattcctctggtctaacttcaacttcttcatctgctggttacatttgtcaagttgcctcttctcccactggttacactttttttagatgtttatttgctctctcagcccctctatgctgtgcttacatggatacagtgttcacaaatgttttaaattaatttgactgcattttctctccactcttccagaagttattatcgatgctcgaatcctggatgccctgtcaaaaagcatgtggaaagggcctctcatgattcaaaaactgtaataactacctatgagggacagcatgatcatgaaattccccctggacggactgtcactcagaatgcagctacaaatactcgcacaacggccactaatggcaagccaggaaccaaatctgagggtaatactgatgatacaggggacctaattggcgagtcgactactaagtcaaaggctggtgatatggttgagtttcgtgtgatcagcctttctaatgagggtcctgaaattaaattaagtgagcaacaacaaaaggataactcagctactaaagacgattctgtcagcaatgacgttatatgccattcaagttctggagttctgtgtagatcaaatgaacagctgaaaggtgaggtaaaacctatatcagaaggaagtaaggattgccttaaggtggttgccgttcatgatactcctagtacagaaagtgaatttaacaagcaatccgcagctgatgaagaaccggtccaaagctaaatttgcaatatttttgaaagggtcacctagttacagaagagtataaatatttgacaatgacataggctttacagatatactgtgggattataattcctatttcgactctaaccttcaactcttcttctagctctctgcttgtctttgggcaggttgactaaatatgcaaattacaattaatactacattggaggatatcataacttgtataccattattatttgagttaaataagatttacattttcgtacacatgtatctaatattctaatgtattgttgaacatactcagctatttgcatgtaattcttgttttgtgcctactaatgctttaatcttcctttcttccatgtaaatttacaaaatgcgttgcagaattgcagtaattgagtatagcaaaagttattccatatgttaaaatgtgtgattgttggtgcagtggtttagattcattctttaatgtaatgatcgatgctcgactaaatataacaggatattggattggtaatttattatttatccaagggtaaaataataaaaaaaaaaaaatctgggggttggagcctggaggtggttcatttagatagccactcctctcatactttgtccaagcaaacaggataaccaattggcgtcaaggttggaggctgagaattttatgggtccatatccattacgtttatgctcattcttggtgcagtctatgcttttgggagatagtgcgagggtctcttcttagacattatttgtttttggagttttacctctttttatattgaattaaaaataatagaaagacttgtaaaccagagaagaccttcctgaaaaatcgtctatatttttttgtgtcacgagttgggtactaaaaccataaggatagcttagaatctcttttctgttttacgcaattatcttattaggcactgctattattttgtcaaagtccacctttttaagtcacgttggaccatgtcaaattgcaagaaattctttcttccttccctcaccaatagacatgcaaatgttgaggtccaccgatgatgcaagtcacatcctaatttcaatggtataccactttcctgttagaagaaatttttttatggagaaggacacaagaattttccttaggagatataaggttgactcgatggttaaagaagggaagaggaagaggtggggggttcgaagacgccaactgcatttctaacaaaatcaataaattaatatttttcaataaaaaaaaaaaaaatgttctgtcaggttggtccaccagagcaacgaaacgatcccattgccacaaaccctcgagtacgcagacccagaatggaaggagtgattgtgccaagttaattctagtcccattgcctactcctcccccacagaataacgataaatttcaaagaatctgatacagctgtgtttcttttctttcagtaaattactagtaacttatctttcttaaatgaggccacgtgggttattttattaatttaatcttaacacttaaaagtaaaatatctatctatttcatctaataaagtgaatggacagcaatgttggaaccattgctaagaaaagccactctactaatattctaggaaatcactttccccagccactaataagccaaacattgagggaccagaaaagattttgaaatgaaagattaatattgctgataaagaaaaatgctacatacaatttcaattgaaattcttgaaacacagaaaatggacaattagattggatttaatgttgagacctttctcattaacttctacatagtaatggaacagaaaaagaagagggacatgttatgcttttgttccccctcgaacattgaggagtcacatattgcccagttctcatttccaagcgcaagaagcaaccaaatctctattcatccaacccagataaagagctccatctctctcttcaagtctatatctataactgtagttctcaagcaatttctttatggtaccattcaccaatgaactcaaagggtaaggagtgaaaccggccattgcaaatcttgacctccacttgccaagcacctcatgtcgttccaccctctcaaccccttcacaagctatgatgttaaccaagtctcttgccaaacaatgctgctcaacattgattctctctttatgctctctgggaagagtcacatctattgactcaaacattgctgtgtaatagttcagagtttcaaggaaacgcggaaagaatgcagcagtgttcgtgttagattcttgctcaacaagtgtcaccacctttggtgataggctcctaaccaacctcaacagcctatccctgtgattctgagtactcacactttcatccggcatgtaatgtaacatgaatgcaaaatttacagccagagcttcccctggtcgaactccaaggttatgtagttgaacatcacaacctgagatagctgcagcatgaaattcaaatggcaccttaaaatgctcagcaagctttgataacctccgtcccactatgtgtagtccaccgccgcgagcataagccgatgttgaatcatcaatacctgtaatccggatgtggggtggccctccaggtctagctgcaaaagcctgaattaaagttatccactggcttccttgaccaatttggaaatcaattatgtgaactctgtcttcatctttcatggcttctgcaatggctccatttgcagacatatacccaaacttgaagtaggggcaaacctcatacagtatgtgcatgtaggagagaagttcagcactttctggttctttgcatcttaaagatttgtatattgaactcccagaggcggccaatcgggcaacaagtccttccaacatgtatactcccaaccgttgaaccggatcaccagaaactgacaccacctgccttaattcatccatcagccattgtgccattagcaaatcattgtctgaaatggatttggcacatgcaataaggatgagctttaggtttttgctagaaattgccaccattgtttgtctccaactgtccatctcaagtggaacgaagttgtttccattgttgatggcactgtcataactatcaagattatcagagtcagggccaagcattacactttccaactctctgagcttgtgcttgaagttgaagctgcttaaatcatcagttatgcaggagccactcataggagagccataggtattctcaggggaatgatactggtcaggtggatatgactgagagtcttgctgcgatatggggctgccgttgggtgagaaactaacagttgaaggggagttgtaaagagctacagaagatgactccaaagtgcagtaaagttctgaagaacttggagttgaaaagtgagtaccatggcctccatcatggtagtatagctgttgatttcgagtctgatactgcggcaagcagtatgcttcaatttgttgtaatggttgatagtacatacttgaacttctatgttgctctgatgcctgcattatagaattgacttggtctcaactgtgttatagtagttcaagtgatctcttccagcagattatatgaagaagcagaacaatggacaatagtggcctagagaaagctgctaattgatactcatggcaacaaagatatagtcctgagttgtcaaggttctctcttctgggaggttataaaccacatatttgacataatctgctgtctgcgtggaaaaatcacaacgtcatcagtgttatcatatcatcaactttcaacttgcttccaatgaattgaagagatagaaagcaatagctgaaatattcagttgacaggaaccagaatataaggacaacttttttgtcttattaaagaaattaggcactcttcagggtcagcgcactgttaaaattagtttacttttttcttctccttctaccgtgtattatcaacaacttgactctcataccaagtcaaacaattcatctctctgcctattttcttttttatgacaaaaaatgaagaactgatggaatcaattagaagaatttccaagaaacttcataaacgaccaattctaaagattattgatttttctccaccaaaaaagaaagaaaaatacttcggaattgaacaaagagaagggaatagatattcagaaagggaaagggaattatctaaatatgaacatctaatttccattaaaaaattcaaaagatgagacaagcagaactatacatggccccacatattgtattgaattagttttcatttgaatgaagttaatcattctaaaaaactgcagaattaacatttgcatacggaaaaaggctcaaccaaatctaatgaaaaatataatttttataaatcacagttaagaaaatttccaattctactagattaactaaattcacttggctgagctgaaaagaagaaagcttgaatgtcagacagaacagattcacaaaccacaaaagcagtaacagcaattggagaagtgcttttattttttttctttctgagtttgatgaagttacagatgttgttagctgacaacaactagttaagacaaggttaatcaaaccaccccttatacagtactcacacacacatatatatatatgtgtgtgtgtgtgtgtatcaaaacaaaatttgtgcaacaagcagataggttcacagaaaaatgcacatcaaatcaaagctcacatctcattgcagaagttggttaagaaacaattaaagagtacaaaggaaagtttgacatttatgcaaaaaccattcacatcataagcagaaatgctaaaacactagaactcaaaaagttcatgggcaagaagtattaacagaatatgttttacttcaccaaaccgtttggagaaacccttgtaaatcaatgaagatcaaaactgaagcaaattttcaaggaaaatatgaagccatgaatgaaatggcttcagtttgagaagtttttgaacataaaaccagtttcttaccaagtttcgaggaaattctgaggttggaaaaccacagaggattagaatctcagagcttgggggagtgtagaagacaaggctattccaatggagaaaaaactaaggcatatgcatataaaataatgaaggagaaattgcccttccattattatagaaactacacagaaaccattggctggtgttattaatgttaatatgatgatgctcggtgacaactcttttttattgaaatgacaggaataccccttgttaatagtatgcttggtcaaatactgccatcaatgccactcttacaaatgtgcctcacaatcacacgtggcccgttttgagtgagttagcatgagcagcttcacttcaatttccttttcagtccatctacttatctattcattttctcttggacctttaatacctatctttttcaaaagaaaatatgtagaaaaaacaaatacttgtatgtttaattttttcttcttcttgtgcacaattgagtagtatcatacatccaaatttaactacctactgctacaaaaaccgtagttcagtacttcatttcatgaccacaccacctcctatatggtttgcattaatgacttaccaactttgatgccaatttggtgactaaagacataaccattcaacatttcaacatacagaagcataattgtatctgcatacatgaattgttttttgtccgaaatgcaacgctgcttctacttcaatgatcagtaaattttatcatttaactcaaatcaaattaatatcaaatgccgtattaaactgttcataatcattaaacgtttatcatttaatgaaaccaaattaaatccttttcactacttagacaactgattaacaagttattcattacttatatgttcactcaaacatttctctcgttttttaaaattattatttatatatttgtcttatttcacatcgtgaaaatcattgctgaatacggtattgaatactgctagtgaagtttaatttaatttgtcaaccaatgataaaaaataaaaaaaaaaaaacctcggccaacaaacttaagttatttgaagtaacaacccccaaataataagaattaattatatagattattgtttaattattatagacaaatattagtaatatacaattaataatgataaatgataatgactatccagggtggtttagctggaccgatatctcttgcacgacatgtatgagcaacgacatcagtgaaatgacatgctcatctcatcttatcggtcgattgtagttaactattattattagctacaaaaaatggtactttgtgttataatagcttctgttatagttttgaaaaacgagtgtatttttctttctgttggtcatagatggacaatacacgactaggaaaatccattgtcatttgaccccaaaccattgatacattaaatagaaattcgagtgtcactgctcaatataccatttattctaccactagcaaaatccaaacttatctctgatttgagaaaatttaagagtaattgtttagatgaaatacagtggtgcagtaagttgtttgaaaatcaaagccaggagtgatatttttccttaattctttcaaattgaagctgagaaatagtttgacatgaaactggtgatagatcctcacgaattaaataacagaaactaagatttaaaggatatttatctttgccatagtttgctcaaagaaagggagactcaacagtttgcaagtgcaattcaggggattgcagtagcatgaaataaaaatttcccatttcagttatttggaggatggcattattagcacatcaaaagcaagaaaataagaactagagatgaatgaaatctgaagtcttgagagaggattcacatttcacactggaaaaagatatcgagcaatatggtatttggtcttgtgaaaatgaaatgtgtatatcttagttgttctctaattttcaaacaaacggtcaaattttgggagtgattgttacaagtattttaatgagaataataataataataataagccgaaccaatataggttggtgtggtgtccacacttttaatctcaggaaaaccatcatccgtgaccatctatgcaagagaaactgatataaactgcactaacttcgaagggatcaaaggtatatagacctaggttatacggaaagaacatatgtaaccgagtgtgacacaggaaaccccacttcgttgtagattatgttatatatagtaattaaatgtttcctactttttgcttacctcacacacaacaaacggtctaaaaatcatcaatttaactcctctaaagtgaaaaactatataaagtgaaaacaagaatttatctactctggattaaaattaaaataccatgtaatcataacgtatttttaattaaaaattcgacagtaaatgcgctcctactttatcactttagacacttttttcactttagaagtgccaaataatcagaacctgacttatacaaaggtacctgtctgcaattaaatcttgagaagtgacaaatctattgcattcataagtagtaattatgttggatcttgtgcatgcatgtatgcattaatctggttagattcactttttatttcaggtgcttctatattttatcttagcttgtgccaactaaattagaaaactaagataaagagggtgtcagcaaattaaggtcgttttcgtaatttaacgaccatattatctttttattttcaaattatatcgatcaatagtatacataagtcatcagtgaattgttgagattaaaaaggtagaatttagatgatgacccacaccacacggttgagttagaacttagaagagagagaaccgtacaataaaggcagtggcaccaatgatgtaagtagtgccttacacttcagctaacatgcacttgatctccatttctatcaaatttagtaattgcaatttatttattttttaaaatctgtacatttatttatatatgtattttgcttgttgcacttattctctttcataatccattgaacttatctcagaaatatccaattagaatctctaaagctttaaaataatcactacttcttatcctaatccaatttgaagttataatgatgcagcctatggaaagttactgctaactcaaattattgaagagtgcacattcctggaggatatctttcataattgcgtcttcaacttattaaaagcgaaaaggattgggcgataactgcattaaggtaggtaaagtgaattttcataatcggtgataattaggctttagccatattttaaattgttttttataatgccaaattcagattttcctgtggtttgtacaaatttaattataagaagcatctttacaatagattttttaatacaacatgaatgcttttttcattttatattcatgtacccaatgcacactagtacgaatataaataatttgactattaataatagggcttaggacaacatgtatcaactttttggaagattgttaataaacaatctgcataactgactttgaatccacgttgtttcaaatcccaaatttaaaataaactgactattttagaagaaaataaagataaaagacaaagcaaagatccactcacgactgtttatattcctatcttggccgtgctactattatttattaaggtccaccatacatacatacacatatatatataaatatatatcactttatacgcgtgctcttatgatattgttagatcatgttcttaatgaaatgctgaaagaccaacggaaaaaaaatgcctaattctttctctagaaaccgtaaatgaataaaatcatgaaggatttttgttttttctttgttatagtcagatattacgtgaaaccaagtgtcaaattattatgcgtccattgatcttacaaattataaagctcccctgccaaaacatgaaatagtctattgatgtaatttagcaagtagttttaccctttaaatatgctttggggaatcaaatgtaccaaagaactaaaccaaaaaaagaagaaagaaaagggaatcttggtaatactttgtccagtccaaagtgagtgaacatcatggcccacacccttacctgcaattaaacctttatttgtcaattgctctaatttggagttttgtgtttattctggtgtgcgccagcgattttgtcgaagatctacatagagagcaaaatgttatttatttgacatatggtggagcatatgtacttaatttagcttctaggtcaagcgaagatgatctctaatctctctcaaataattttttatttgcttttatggtttgcatctgagttccagttggacaagaaaaatgacacgagatgaaatgaaagtgacataagccatttcgccatcatcgattgtttggactctaatttgattccccacatttagatcttgatatcatgtcactgattgatgtaaaataattcttctgtcttagatgaattggccgaaggatttgaatatcaattgagttttttttcttctttttttttttttttggtgtatatagaatatcaattgagttgaaaattgctttataaaaaattgagttgaaacttaaaagataaagcatgattaaatttcagataaatcttgaaaaccaatcaagttttaatgaaatgtaaaaaaatttaaaggtgggtaaaaatttattttgacaaatttaagggaattctagaatttggccaaaaaaaaaatggggcaaataccaaaccgtttttattttttgttgctttttgttttgtttttcttttacgattagcttaagtgaatatagggttgaatgagacttcatataaaaggcataaatccgagtattaagaaatgaaaagaaaaaaaaatgaaaggatgaaaaggaaaaagaaaagaaaaaaaaacttagttatcattttataaaaaatgccatcacgtaattcttgctgaatttttggattggccttttgaagttaggatggagttttggatgttctttgctttacgcctggacttagggccatcaatcaactttctgaagttggtctgttgtttcaaatgtttcggccttcaagtctaagtttcttacccttatttgataataaatttgaaagaacaccatatataatagtttgtttcaatatttatgtggtggaactcagagtttaaaaaaaaggtttgcttgttattgtaatacctttgttgttttcttaatatttataatagtttaatttgatttcagcactgataattttttttcaacaataacgactcaattttgttagttacaatactatggttaaaaaaagagcaaaagtaaaacagtacatctatccttgttatccttctttaatgtacttcattcataaagtagtataaatctaatcaaaatattaaagtcgtctaacaatggcatgttttaacttcaacgaattgaaactccctttcaggtccataaaaacagagtaatttcccctctctacacatttcaccatggttgactgcattttcattgttgaagagttaaaattatttgataataagagataaagtcttgggaatttagtatgatataataagattagaaccaacataattaattccaaatgttaattttaataagtcaatgactcataccaaactagtataatttaccattactcttcacttttttgtccaatgtaatattagtttcttctatattacttcgcatctcagacgtggacaaaacaaaacttgacaactaccacatgactagatggtatttatttgtcatgtccgaacgttaggagatgagttctatgattctatctcaacaactatttccacaggctcacttcatgtgtagccatcgttatgagatctgtttttcttctcccacgactttcacattgttgtctctgtacaatatctggaagaataagaagatacgtttgagcttgcaaaaataagacccaaaacctaagcttactggtgaatgtctcatcccctacattcattgttcaattcttctatttacataaaattttaaaacttctttattttagtacattatcatgcacaaacatttacctataaatcattaatcttatcatatggtaaaaaaaaaaaaaaaaaaaactttaccacttagtgttaaaaatgagttgaaatgaatggaactaagtttagctcgtctctttttaataaaaattaatttggtttaaaatttaatttgagttcaatatatcaaaatgatgagcagttggagacaagaaattggtagatatctcaatcaaaagggcaaaatgcttgcatctggccatggcaatagaatagcactttaggctagaagaccctataacttgcgtgccttacataggggaatgtagggctgcgtttgtcccccactcccaaagcactaaaatgaacttgaactcttagaatgaacttgcaatactgttgcatatgcacgattttctacttatttagtatatttatttatcataattgaatttatttgttttcagctagatgtgaaagtaaggaagatgcgttggtcgaatagtagcccttaacattgaaggcgttggttaaggcaggagcagaaatacttgtgtgtccatattatacaatatgcatacaagaaacggttcacacacgttctactacaacctacaggatagcgaatgagagtattcgagctttctttgagaattatgttgtacaaaacttatatataattctataaatactgtttgtattatttgctaattagaattagagttccaccttactaatttgtgttaaaaaagtttgtattaaaaaattatgtaaattattgagataaaacttcaattctaataaaaaaacagtgcaaacaacactgaagcaaagtttttttttcttccatatatattctacacactctaaccaataatgagtgaaatctctctgctaattaatgtccttttagtgcgagtcatgcctaagttaaaagacaatcagacctaatgataaagtggagttcattttattaggcatgtgacatattagaaattaaataatcccttttcttaagtccataaaaattctccacgtagcagttttcaataattgatcaattcaattcattcatataaatgggaggtttagagtaaatttcagttttgactttttttaaaaaaaaattagaatatttcaattaaaaattaaagattaatctcttgatgtattaaaatttatttaagagattgattttaatgtataaacaaatgttgttttataaacatacatatctagagatcaactcctaactatatatttaagagacataattatctatcaattatatcacatcatatttttttttaactaattcatttcccagttatgcttaactaaacaaaaataatatatgatatgcaagtttgaagctagtttaaaacctaacagtaacagtaaaactttgaagatcaaactttaatgattaaccaaactgcataagcttatcaaaatcaagaggggctctagacattcaagttgttgtcagaaaatcttgatcaaatagcaaaaggttgtccctcgaccttggcatgccgattgtagtactttaggatgcagagtcttgtaaattgcatacttaaaagacaaaatgtaggccttgctgataaatatttgtcccccgtttccaaattcctaaaatgaagctgaactcatatagagtgaccaatgtttaatacacacactcacggtagctgctatgtggggctaggcttaaactcggtccaattacatttctgaaattttaccaagtttcaggagtgtgtttcaaaaccaaaaagccataatgagagcgcttgacttttgtattcagttttgctgtcatggcaccgcccatgtaaggccttttgggagatacattaccttaatgttctgtcctttttcatctgcagaatttgtcctattcttatccaatcaattaccaaagttgcagattttgtaaattttaaagggtttacattgttcatcaacatgttctgccatgcattttggccaacatatgggtccctcttaccacatgtgcccatctttaatttggaacatattctttactcggacatttttatttgttcctgacgcggcaaattccaattgggatgtgtgtagtggaggagtttgcatgtgtgtatgttccaaatctgattttgggttagccttttcctttctcaatttcaaaatcatccaaatccatcactccaaataaatatttttaaatttacaagttgcttaatgctaaggcatgcgagggtgtgtgcacgagttatacatatatcaaatatcaaattgtctatttttttatattgattatccatcttctctcttttgtgtagcagtaaagaataaagacactagctcctacgaaaagcatattagccgaaaagcaaatgacacgtttaaaccctatttcagagggaccaggtaagcaagtacttgatacttaattataatttacgttagccaacctatattttctctaaactttttggctaccttcttgacacgttctttgttgataataagtcatttttctagaattgaagtttcattaccaattaccatatataaatcgtcaaacagcaagtcagagtcagttatttgatgagggcattccaacacactagactaaaagaatttgtttgacaaggtctctttctttcctttaaagttctaaatatttgggaatttcaagttgaaatattggactggacgaaatgaattgcgcacttgtcaagcatagtaccaaattttaactggcaaaccaaaccattttttgggtcaatatcatcaccttatattccctactcaattttcaaggatcgaatacgtttgatcaacagaaatactaataagtttacaatgtgaagaattagttttgaataaggaaatttataattttacaaagaatagtgtgttttgactcctgactcgaatcgaataactccataattaagacatgcttttggtaagattcctgggctaggattactcctcaattaatgtatacttttggttttggttttggttttgtaatttgtctgatgtcttaatcagaatgttggctttatttaatttattcaaatgcagagtcaaccaaggactttgactttcgaggaaccatcctgttaattctaattccaaattctaaacagagaccgtagaaagctttgcccctcaaattatattctggttgactcttattgcagggcttctcagtttggttccttgagtattgaagaaaccatgaaaattccagaaatataagagaaaaaatattacaaaggaataatagtgttatatatatatatatatatatatatatatatatgcttttcctatttttgaggcaacaaagggattaagttctttgagtaataaaggatgaaaaacctaacttacatggcatggcatgatgattctaagagagaaaaataaaatttagttaaggactagtttggtatgataattacaatgaagaactaaataattattccgagtggccacgtaattttgattatatgtttagtaatagtattattggcatgaacgactatttgcaaagagtaagtaatacgaatcaatatcaaccaataaagataagtagagagcgaaaaaattatgttgtaaataaattacataagagacattttatgttctatgcatgtgttgttcggaaacagttttgtatttaactagttaggtgacccttgtcatgcatgaattaattttgtttaatatttattttacaataacaattaaatatgtaatatgatacatcattaaatgaaatttaaatatgaacacagtcacaatattatattttataaaaaaaactagaaaaacacaaattgtgtatatacatacttgcctcaaacaacataccaaatttttttattttccaaccattgttattaccaaatccatcaaaaaatacccccaaaatacataaaatattaaatacatatttttctcactttatactcacacataccgcaaccaatatcttcgcatgcacttgtaggatgttttagaattataagttcattgcatccaaagctctccaattcttaatgtaactcaattttgtgaactacatttgttgtttgttactaaaactggctcatgaaacctgcatcactactcattgcatctcgtaaaacttaaaaatatatcgaaaaataaaaaattaaccttgaactttgattaaagggaatatcaggaaaaaacataatcaagcattttgatgttggggtcaaagggaacatcagaatttagatggcttgaatttaaaaatccattttggccttcaaaatcgcataattgaataacttgagtagcttttgataatgcaatttgatagaagccgagaggcaaaaactacaaataaattaaaagataatatgaagattaataaaacaaaggaggtagaataaaaaattcaagaaacgatacataaatgaagaaaagatgtgttgcctgacttcaatttgatatgcttaaatgcctgaatctcaaattcaaattgtcacaaaaaataatgacttagtgaaatatagaacattttaaatgataaaataacttaaaaaaagaactgaaaaatgtagaagtatcttttgtttctcatattccaacatgctccctcttattgcttgtggtttgtacctcgtcttattaaccctaatgtcgaagcatgccctacaatgttggattgagatgcagttggcgatgtgacaatcttgtggaagccaatgtagttagcttatttgaaagaggcaaaaaaatgctacagagaatttaattgaagaaaggaaagggatgaagaaaaaatggctagtacctccatggggtgtaggtgaagaaaactcactagagcataacacaaagatagaaagaaatgaaatgagttgataattaagggtgttgggaagaaaacaaagcatcaaatggaaaaaggaaggtataatgtgaaaaaaaaaattcattgaatgcataatgaaaattgaagaatcaattaagaggttgaagaaaattgaattgatgaaataaggtgagacgaaaaaaataataacattaaagaagttgaatgattatgagtactcatttagctaaatgtgttggcattaatgagcatgaataacaaagagtttttttgtaagttagaaaaagaagttaaagagtccaaaacaatcattcaaagtagtttaataagaataggcaattatgatgaaaaattaggaatcataaataattaaatgttagtagagaaatatggaaagacaaaaaagtacgagagaaaaggaggtgaagattttggagaaaaaaatttgttgaagaaataagaactattacatatataataaattctaaatctaataatcactcttagtgtatatttgttttgaggggaaattttttatttgagtaaatagttttgttgatatcagctctaaatgtactttattaattacaatgtaaaatgatttttacatttctaatataataaatgtttttcaataaaaacttttcaaatttattttcttagcatcaattttaaaggttaatgtttacaaaatcattattttaacttcaatatacttaaggtatttttttactaaatatttctactgatgcagttaaaagattaagggtgtgtttgaaaacccatttgatccacgttacggaagttttgcactttccacggcataaacacagaagcaatttagcaaggtctgtgttgaattagcgttgaccgggtttagttgaacccaaatgatatttaaacactcactaaccctcgaactcaaaatagtagttaagtaaaggcattttcaaaaataaattcagctaaaactaacccatttttcgttacaaccaaactctgttaagtatattaaaagaattgtcaacaaagcatgatttcctttttgatcaggttaacaaacctttccaaataagtactttttaaagcttaactccactgatcaaagttctccaaaatccaaaggaataaataatacttgtaagcccatttacctattcatgggctgtacttctgcatattgaggcccatttaccttttttttatttttatttttatgattcttaaagagtaaaatttatggagtaaaaaaacaaactaaaaagagttaaatttgtaatccatccatttttatacgtaaatttagattagacttactatttaaagacataaatgtttctgaaaatataacagatttaggtaaaaatttcttctctaaaaaacaggtaaacatttctcaattaaaatgagaatgacactcactttatagaacagcaaagaattctttctattcacttcctcttggatataaatgctttgctcatgaactacggttaatactgataaacaaattaaggttaatgattttaattattaatcaactaaaaaacaattttcaaatataaacaattttagattattatgacaagttttctattgtaatgatttgaatgtgagggacagagtaatatatgaaaacaaggacaggttgtgcttaagatagaacaacttcgtgccaacggtaccaatacactctttgatccacgctttagtaatatattaaagttaattgtttcaaatgtgagggccagagtttagatcattacaatagaaaaatgaatcttcttttctgttctgttccttaaaaacagatgttcagtaacaatgccaaatatttgatgtatgatcaaactctctctctctctgaagatgcttatgaagatcaaaaaactctagaaagacgatcacagtacccaaaccacaattggacgtggggtgtgtgcactgtgagaatgaaaaagagagagctagaatgtgtgtatcttgcacctttggtgatacttctatttattctcactgacctgtgcaaaataagggaaattcttgcaattcttgatcataatctttaaaagatgaaccatatattatcaatattcttcatacaaatattatccatgatcttctcttgattcggataattatttaggaggtaattatcccttgaagtttgtcataaatctcgttgtgctgaccgtactgggcttcttggtatttggcccaatattactcaaccttaacacactctttaacaatatattaaagtgtcactgtttcaaatctgaggagccattctttagaccatcacattagaaaaaggaaacttcttttctgtctcactctttaacaatatataaaagtgatttgtttcaaatgtgagggccatagtttagaccattacattagaaaaatgaacatttttctctctcttctaccctagtttttgttttcccactgattaaactttcaattctagaatccaactctcgataactaactcgatccttctaccttgattcacaaattgtcatatttcaatcgtattccttttgaattattagaaggtccatcaccacggtctaattgtcaagtttgaatttgaggagatctcctacaattcatgaatgaaatggtccaaggcccagcttggttggaagagttcatcaaacttacatttaatcacaatttatatacaaaatagtctttcgaggatgtttgatgcctctgctcattagtcattcctccataactctgccccgaacctatgtttacacttaaaaacaaactggtctgcaaaaagacctaattttcaaaggttgaaccagctaaattcataacttctaatatccaccgtctataacaggtcaaatatttttcatcttgactgctcgttaaataattaatattccaccaatcacaacaaaagtggtccatcatgaatcactttatattagtccttgttaagtgcagctagagataatttatactaaaaatcagtatcattgaatagtaacaagagtgacgtgatcaaactcgtcatcacttaatgtgtaatgatactatgttaagaatcaataatcctaaaaaattagagattttgtactttgggtgcataacatgggtagaagaatcatatcctttttcaagttaaattttctgaatataattcacaattttattagaattttttttagtagtgatgcccaccaagggatcgtatagaggggcaagcaatgttggtccaagatgaatgcatgccttcttaagtcaagcagcctcccgggtttggtccggaacaagtatacctgcatgtttggatgcacgtttaaaacaacttgattcacgtcttttgctctatttgacgtggaaatcctcttatacaaacacataataccttgttaaaaactgagttcaattgagctacacgtacattaatgtaggaaaaacttaatttagttttgtaagataacaagttagtttgctagacaagattttattatgactttccagcctttgacctagatcaagtgaattgtaagatttcagcactatcaataatacaagaaaaaggccccaaaaaaattgcttgattgggagtttgggacacataaacacacaaaggcacgagctctagtttttgctgcagttattttaagtcttcattcacggttgtcatcagggaatgaagtcatagtgacaagaaccatgacctgggcacaaacattaagcaaaaaggttataaatcaccattattcatacacttttctgtggtgcaaaacttaaataattttaaatcgggattgttccaatccctgacaactgaaaagggactcgtgtgtggaaccattttcatagaccatttattgtgcagaacggagtggcgtaaaagcagatggaaggaaaaaagtgtaaaagaataatttcttcaggttataatatgagatgagaaacactatttatgagattataaagtataattgttcatcagttgattgatctaaaatttgtttagtgagaatgagaacattactcgtgccaattcagttcaaatttttctgtttcacgcacgcttaccgaagtagtttgaatgtagtttaaagattttggatttatttgtaaaatctatacttgacagattaaccttcaagcatgaggttcatttaaattgcactaattgactctgtcatgtgaacatgcattatgtcctagttaaaccaaagtaggaaataagtgagtggttatcaggaatctatttaatacttactaggatccacttctgttgttatggcagcacctctgaagtggcaagaacctccactgtgcttgaacttctgatagtagctgttgaaggcataagaagcatggtctttcaatgtgtttggtaaatagcatggttggtttacttgaattttgctacaatctgcaccccctttcccacaagcccaatccaaggctgcctgcaactcagactccgtggtctgctcatcagctacacaccattgctcaaactccgcatacgctgcatgatatgtagtttttaagatgaacactttgttgaggatgaatatatatgtacaacatctaatctatcatgtaatcaattttaacttgaatgatgtattgctctttattctcattattataatctcataacaagtccaattttaatccagaatcttattagattaactatttaatcaaacggtaaatatgataatgaaatcaaaaaggtttttttcctcaatggggatattttttttatttatttactaaatagggtagcatttaaaaaaattaccatttggggttctttttattttcacgactcttttttatttaaaataaaaattggtcgctaaaaattgcgataaaatattgtagtcgcataaaacaacattctatcgcaaaaagtattagcgactgaaatagcgactaaatttttagtgactaatttttaaccatatgacacgacttaccctcaaatggtaatttttttaaatactgcccccatttgataaatgaaaaaaaaaaaaaataccccctaatggtgaaaaggccaattaaaaacaatagagggagaaaagaagtaactaggaacatttcaatgttttcatttatggagtagaggaagcacatttcgattacctgttttcggaggaatcatgaacaggaaaagtagaggaagcaccaacttcagcatgaatgttgccatttttggagaaaaagataagagaggctttgctgattgataaagactaaagagtttataaaatagataccaaagatataagcaatgtggttacttatatacatagccaaacaaaaaggcaaggaagttatgggtctctttctaacggctaagaaggaaatttatgttattctcttgcaagtggatcatgcagggttggtcacattgaaattggggctctcccttgagaataacatataccatcattgacagaaagaactgagctgtaacatagcaaaagcttatttgttatttctgacgtcgctgctaatttcagcggttacactttgtcacgtgctccacaatcacggaaagaaaaacacacataaaagacttatattcttaactttctctgatgtcagacgttcttccaactcaacaaacgatttacctttttttccttatcaattacaaaatgattatttatctaccttatcttccctttccccacactcttctgttttaccaccacttctttttttgcctttttcaatgggaaaaaagtcttggttcgttagtggtcctcatgttctactgtatctcatttaccaaaatctgtagccttgtagctcaatattcaactttaatgaattgaacattttttggtcttgacaatatttaaggaaaaaaaaagttacaaagtgacaagttggaatcttacaagtcacaaaatattgttacatatgccattctactggtatcatgtaaataattttgatttacatgttacttacaaaattatgagggttcaaagatctgtcattcctttccatcttggcccccaaaaaatgaaataatgatgtcgacactataagatttttatcttatcctactagctccaaatataaatatttacaaagaataataagagatgggaagcaggaacaaaaacggggtatgtacaccaaaacgcaattatgccttctgttgacctcctcctgtcctgcaataagtgataatatcttgaactcgaaatcagcatcctggaaaagaagaacaaaataagaacaaaatttattaatgcgggaataggcttatactcttattaaactcctataatggctcaagataattgaattacaaaggaaatttagaattgtaacacatgtatatttcaatgatccatttctacttgttaaaattataataaatatatatgtatgaaatgcgcttataatataaaaatcctgggatgataaagatggtacttactatcactaaacaagaccatagctgagatccatgatgctgaatagataactttgatgctggcaagcagtctcaattaggaacacatcatctggggcatgtccaaccattacaatatccggacataatttagccaaaattaatccatccgctagctcttttaatggaaaaccaacaaatggcattcgatgataattgatatcatactacacatcacagtccacacttgtcagcaggctgtctgcactaattatcaaagatttcaaacttccacactatgaatctgacttgaagaaacgtgccattgctatgtagagcttctcttcttcaaatggctttgacacatagtcatccattccacactttatgcactcttcattggaagactgagttgaatctgctgtcattgcaagtattggaatgtgccaataagggatgctaccaaacatctctgcagatgcttgcccacacgcaattttctcatttacctcactctcaagacaacggatttgcctcgttgcttcaaaactgtatcatttaagatgaagagaaatacttgtaagttatatctcagccatgtacccagaattccaggtgtgagatcctatctagaaagcactcagtaatctgttatttcttacacaagttaaaatggccatcgatcacacctaaggatatcatgatagcatgcagattggggaatttataaagtttcttatatacactaactgagcccccaagaggatatttcttacacaagttaaacgcccccctagaggataaaaaaaaaatcacaagatagtttcatacattctaataaaataaataaattacaaggcaaaagcctaatcattatatctatttacataagattgagtggacacttttacagtttaacaacacggccatgaggcccgggaaaaatcagtcgtggttaaaatattctaggtagtaggttcttaacaaaaggaaataagggtaagggcctgacttttggcaccagttcctttaattattatctactgtttttcacgtgttttctctggtacaaaataaacttactagaccagtcattgctccttggttctattcttataggaaagaacagtgtctccatttgcattcaaaattgagaaaactaaaactaaaataaaaaataggaataagaagatatgttacccatccatttctggcatttggagatccatgaaacaagcatcaaaattatgtggcagtttaagcatctttagagcagccctgccactctccacagcagtaactttagccccatatttctgtagaacaccttttgcaactcttctgttcactgcattatcatcaacaaccaaaatttgtttgtcaattaataaattcccgagtttggacacttttttcctatttactctcttgttttcagtgccaagggatactctgtaacactgaatcaaagaactaagccaaagaggcttcatcagtatatcatctataataccaactgacttgagcccatcctgttcattggagctaaggtgggtggccaggagaaaaatctttggtaaattcattggatcccctttgatgccattctgtctacgtttcttgattgtgtataagatatgacattctttatcccaagcatccttgtctataagaatcatggccaactgggtcgacatactgaaggaacaaaaacagtagtagtaatttagcaaataatagcctattgtccagtacaagttttttttttataaaaaaatcaacaaatataaactagaaataaaacaccatgtttacttcatgactaattgcaccttaaagttactactgttgaacacaagcaattgccaatattgattaaaaccaaccagtagcaaaaaaagaacaatgcaatttattaataacaatataggaaccgaatttcctacagaacaccaagcagttcaagccttcacaagatcacgcaaaattcatatccacacaaaagcatgcattgaggattgggtcagtctgaaaaaaaaaacatatatttcatgtgtacaagttgtttactaagtaaaatgatttcagaatataaattatcagtatcacctgctttatggggaatacaacaacaataaagccttatcccactaggtgaggctggctcgtgtgatccatgtagccgctctcacctagtgggataaggctttgttgttgtattccacataaagcaggtgatacagataatctatattctgaaatcattttacatagtatatgacttgtacacatgaaatatactgggtagtgccctgatgctattgaagaatgacagaacttaaataggtaagttcttaaggtttattgtgcgcaactgtcaactgatttggatttttaatttcaactgctaaagtgagtcaagtgacaaattacctcttgttacatgcattagatagacaagagcatgcagaattcagactgtaagttacatccacagacattcccaatctctgcagatgatatcttgtgacctcagctcggatttttctgctatctaccactaatgttctcaatccttggaactctgaaccaaaatgattattctgccgcattgcatccagagacgtgctttctccttttctgaaagttccggtaaaggaaaaagtacttccaattccgggctcacttacaaatccaatttctcctcccatgaggtcaactagacgtttactaatgctcagtcctattccagttccaccatatgttcgggaggtggaactgtcagcctgcataaaaggtgtgaatatgcggctttgtgcatctgtaggaattcctatacctgtgtcctcaactattactagaagttgaataatttcaggcttatttatgccacctaactgcttaaaatttgcccaacttttccatctgttgcatacaggaaacccacttaacgtatcatatgttctgtttgatacgttctggttcaagtttaagccttctctcagcactgcgtccataatatgaagtgggttcttcacttcatttgccagatgaacagagacaaatacatgccctttatcatgagtgaactgaaatgcaccaagtaaactgattaatagagaatataaataaccaataagattccttcttttttattccaaagataagaaaatacactaatttaaaataaaaattcgaaagattattccaaagtctaaatagaagggaggtaaacatataaatccttcaaattgtttatgtagtattacaatgtctgcccattgcattgcatgagtcacttactagtgagtatatatataaggtgatattgtaaagaaataatgaataaaaaacaatatcaccaggattatcaatgaatttacttattaacaccatttcaatatcaatcagtaaagggacacactttcaaaaggacaaaatgatgcattgtttaaaattatgagatgtttccagcatcatgatatatgcaaagaataaaatgggttaaacccacccaaaaaataacaatacagcatgaaataatgcaaaccttaagtgaattgccaacaagattagtaattatttgccggaaccgtttaggatcgccaatgacaactttgggtacttgattggatgtataaacagccagctggactcaccaaaaaagtatagagaacacaagttcatgtaagacttaatgtacaaattataggaggtacaaaactaaggtagcggaaagatacgatctcacctctattactttttcattagatttttcagagaaaagtgataaaatttcatccagaatagctcgtggatcaaaggctacagcttcaagctcaagctttcctgcctcaatcttagcttgatcaagaacctcgcttatgactgagataagatctttaccactcttgtgggcggtttgggcacagtccatctggttttcatcaagctcagtatccattaacatttgcagcatacctggaaaattatttgaaacagctgataattattactgagtattgacaggttgggtttatctatgaaaacaacaaatactttcaattacctaaaacaccattcattggagtcctgatctcatgtgaaactgtcgcaagaaactgcaaaaaagggaaagcaatccttggaggtcaaggtggaaatattaattttaattaagtaaaagaaattataaaccatcagaactcagaaataactttgatgttgaaagatgatcatcatgtgatgcaatatacatatgaaatgtgacaagaattacaatattcttgacatcactctaacaattgtgcggcataacagaaagcctaaaaaaactacgtaccccattgcccagagactcctcgctaagcgaaggtaagggggagggatattgtacgcagccttacccttgcatatgcaaagaggctgtttccgaattcgaacccatgatcaacaagtcaccaaggcacaactttactgttgtgccaaggcataacagaaagcctaaatcccataaatatatcacacctgagattttgccacatctgcagcttcagcacgaactttcagctctctcatttgacgatagtcatcctcaacttttgctattctatttattgctgcataaaaaatatgacccagaagcaaagtaataacaaacacccccactgatgcattgattgctgtccaaggtaatggaggcctctgcttgaacctgcaaaagaaaaggaaaagaaggaattgtgctggtatgagatttcaattctttggacacaacacaatttttttaaagtgtgaaagcaaacctgcagtgcatctcatgtttgcgtagcggatccccaaaatctaggctgcttatgtatagtaggccagtgtcagcaacatcagtaccatacattgtgattggtgcagatgcattagttgtgtcataaacatttacaacaatggtttgtttactggcaagttggtgtagaagcttgtccaccagtgatggaacatcataagacgcacccagatacctgccaataaataggtaacaatactcacataacactgtaattgttttccttttaggggtggtggatcagagcacaaatgaaatgcatattttaaccagtagacaattagatgtaggattaccccacagtagctttgatacgctgctccagtgtagcatctaaaggaagattagtgttatagacagcaaatgtaagtacaacacccagatgattggactttagtagtttaaaaggggatgtcagaaccccctttccagacgcccttgctctcaaaatattctcacggtcctcctgtgtaacaatgcaacaaaatattttctgttaaccagacagataatgaggaatctaataaataattcaatagacaatagtaactcctagtcttatttcttcttaatctgtcactgagatgaatgtaaatcaactgattaggcatgaaaagcatgtgataccagtgctcagagtcattttattgatgttgataagtaaaactcttgtatgtagttgattctgtttaccccacatttgactttcactgttcaaagtaaattatataagatactgtttagtgatctccagttctaatattccacttcatgtatacaaaagctccaagcatctaatgcttcgacctaaaccttgcataaagaaaatacagacaaaaaagtctttctaactgatgacttcacactctagttttctcatacatacttgtgcagaataaatatggtacgaacattaacaggaatgtaaaatttgcagtttaagccattgccccacaatttgcttagaaaaagtaaatcatgttagggtgacagcaagctaagcaagacacaccttccctgacatcatgtcaatagatacaatatgggaaactgtttcttgagcaaatatcactggtgcatattcatcttgaataggtgctggatccaaattttctggaatacaatcttgtactaatgcctcattctcagtttccattttcttaattgtccacccatgctgcttctcaaaatgcatcctatcagagtggagaactttcaaagcataagcaacaccactagtaagtggtctttcaaatgctgtactctctgtatattctccaaaaattttctgcagtgaaacagaagcttcaatgttatttatccttaaattttcttttgtttttaattgttttccctcaagatggataatattacaacaagaacaacatataaatagcagagagttgaagaggactcataaatttaatgtggtttcaacatggagacttatactatgcaatcttcacacatatccaaaccttactggtctaatacaatcaaattcagtgttaaccatatcagaattacaagtgaaaagaggaacccagttcaaaccttgtacacttttttgtaagattagcatatacttaaagcaggtataaagttgttaagacgttccgcattagctagaaatatggccaaatactccttgaaaggcttgagccttgagtaattccccctcccctttgagctaacttttagagttaagttagatcccacccatttcaaatatgataccaaagtctattcaatcttgatgttaggtacctgtaaatgtctagtcttacaagcttcacactccgatatgtagtcctgggcatgaggggatgcatgttacgatgctccacaatggcttaaaacatggccaaattattccttataacacttgggcaattctctccccctctgttgatctagcttttggggttgaattaggtctagttcatttttctaataaaatttataacaatgacaattagaaatgtggtcaaacatgcttttcttattatagctagtaaaagtgccaaaagatattcatttgataccctcattcacactctcctttcagatttagtttttgcaacaacattaccataacacaatgaaaaaaacagagagaagctagaaattttatctaggctagttgtggagaaaaaataaatcatatagcaagagctttacttcattatctatacttttcaatagctcaaacttttgacacattacggatcaatggcacaacctgaattcctccattttttttgtcaatattatcatatttttcagcatccccacctttttccattacttttgttcattttattttattttatatgtatgcagtttttgctacatgaaagtgagcaacagtgccttttccctagtttttacagatcatttggatcagattttgctttccttagaatagaaaaaacttacatttccttttttactatgcagccactcaaatatgttagttagattcacataagatatactaagcaaaagtgtctaggagacatgcaaaatatctggagtcactggccatgaataagtctgcataagatgggagtgggagaataccaataagagaagagaaggacattgagtacattacctggtcaattgcagaaggatgtttaccatggtgaaaggtagatacaaggatagccagagcatgaacatggttcatgctcacattaaactgatcttgcagcatacgggctctctcatcacacatatttgctagcgtttcttctcttctccgcataattcccatattcaggtgccaaaataaccaaaaggacccgattattccaagtgacacaaatataactagtaactttttcctccacctcccagcaccccttgaaggacctcttggaaaatgtttcaaccacttttgttgtgcagctggatgcccctgaactagcttctgcttttgattcctccatagtaaacagaagtaggacattataattccaatgaggacccaccagcatcctttaattaaattagatgaactcacatgataccgaattgcagataccctcagttcccatgattgcacaatgttctgcaaagccaaaatgaattagcaaattaattatatagtggaagtatttgtttcaaataagcatgcaaggagtgcatgccttcatagttattggacaagcttacaatcagaatctatggtataaatcacattcacaagtaacatgggaaagacaatatttggagcaaataaaccaaaatccactacttttccttgatatgactattattattaggctgtaggttgaatgatttgaaagctagactatgatcggtgatgccctgtcttttacacatcaatacaaaaatttattatagcactagccaagctatagaaagaatgctatgatgccagataggcaattcaagggaatcttttgattacattcaagtgcatacaaaatggtaccactgtagatccagatgatgcattattaatagttacatttctcacccagcttccacaaactgagcactcttacagaaaatgatatttaggaatcctaaagttcatcactatgcttctttttttatctccattcaatcaacaaccatattatgccccccagtataggttgagcagtgagaaaagagaattgtaagctaggctataattcttgggtactccctaatttttaggagaattaacaatttatattatggaacttttgggcataacaaatatatgccttagctttagtaaagattctacctttccgtggtgcaaataactaaccaaatcagttgaaagtgcagagtgcgaggccaatgatacacaacttttcaatgggaatgataattcaagccttgtctggacataatcattgagaattggacattgttctgtaggttctacagtgtctgcaacacatgtatgctcattttgtaactcttgattctctggacatattaactgtggagtactgaccatgccgctgcttaacagcatttgaagtcttctttcatcaatacagttggataaaatctgcatcataaacttagtaagacataggacaaagagcaccactttgttactattcatattcatctctgcaacaaccactgttttctattaaatatctagcaagagagtatccatcacttttagaacttaaccggttgtacaacataaagcgatcctagagaaaccttgcggaaaaagcatcagaatagcatagtttataccctttcatttaagacaatctattggttctcaatattttacatctttcacttcatctcaaatataaaatccaacaagaagttgtttatttagtgacaataacgcccaatagaaagaacagttaatacatagaagaagccaaatagttaaagtttctaagcaaaagtaaataattatgaattatcctcagcgaccacgatatggcgccataaaattgaaagagtggaggggaaagtgtagctcacctgatctgatccagagaacaaggaagccaaagcatgaatctgtttcctactaacattgtaacgttgtagcaaggttctctctctctcttcacaaattgcttcattctccttgctgaccaaatacttactattgaaactcaagatgaaccaaacactccctatggcaacaaagccaaaaaaccaaggaagcaagggcttcctcctacatgtcctgggagaattagacccatgcagaggctcattcagcttccaagacttcatatttgatagcaatctaccatttgaagcaggaagccttcgattcacagacatccttgccaaattcaccaacgtaacagtcctggagattcaaggcaagccccagcagcttgagcagaacattcaaaaagctgaaccaccaagcaccccaccatgaatcttcaactgcaaaagcaaaattgaagcaaacccaaatgttttctcagcaatccacccctcagggcataaagtttggtgctttatgatacttccacaaggcaaaagagaaaagttgcacaaaacccagttgatatatatcaaggaaggagctccactatgcttggactggagtggcccaaccaaaaagtttgtttttttgtgggtatccgtgaaggttgaagttgaagagataacataacaagaagaggaggaagaggagcatggggtaataatcacaccaaatcaaacccactgagaggagctgtgaatgagataggaaaatttgttctttttctataacaggttgtttctgcctcactgacctctgaacacccaacagaagcatcaaagagtggaacaatatcacacagtgaccatcatcttcttgcaaatttgctgatataacccattttgtttttcagaaagaaaatgttaaatgtccccccctctctctctctctctccccccagtttggtgtgcagcattagctaattgaggatggatcatgattatctcatcatctggtggggaaggtttaaccaaaagcaaacaaaaatccatgattaaaaataaattttaaaaggaaaataaaacatcagttttttttaatatcaattattactgtttagttttttcagcaatatatagcataattgaatttttggttaattttaattctttttttttaacttcgatttggtgttttgcttttgcaagagttgacaaagaccgcacccttcagtgtttaaagagggagtactccaactgtgcactgcagaatacggatttaagtgccagaaaagataaaagagagtcagaaaaaaaatatgtgagaagaaatggtccggtgaaacggtgagagaatatagagagagggaataagattttgaaagatagggagagagaaattaaaaaaagggtaaaaatggtaatgcacgtagcacattgtccagttcccagttccatcataagtggaaagtaacactgtaattttatgttcaaaacgtactggaagaagaatgggcaattattcagaggggtaaaggctaatgtgcgcatggtgccaaaatattctggaatcaatggttttgagaaaattatataggtttgataaggggtatataggtgtaatgggggcatcaaataaaatgaatgtcggctatataccttacccaccaatatataataatgaacgaaagtgagaatcaacccagaaatagtactaaacaaagtgccaatttgattaaaaactactatcaaaagcataattggtttgaccatcattgcatggatattattatattaacttaattttttttatcattttaaacatttaataaggtaatcttaattaggtggtgatcaacggcacaaaaaccctcatatacagttttagagtttagatctgtgaatttcttgccttgagagttaatcatcattgtgggatatggaagtagggttatgcctattaattaatgatgatatatgattagtgagaaatacttttttcggaaataggttaagttttaaagtggagtcccacttttatgatttttgctatggcggtgagatttgtcatttctagcaaaaatagtaactaccaacactgttttacatacagccaaattattgctgtttattgtcatgccactttttcttgcgatccagaacatttccagtgcttaaacaatattacaatctttacattaatcaatgatgctaaggagaacctgttatacggtactgttatgttggaaagttaagaatgtataagtttcactcagagagaagaagttttcatagagttcaataaaagaggaggaaatagtatatatacctacctacataagtaaaacctagctaagagtggtagacagacacagcacagattattgtctaatgagattacatgagcttgaatatttccttgacgagttggtttcatatgctaatcacatatgtaagttcaactggatagccttgttattgtttatgtaagtcaatttatttctgtaaaagaaaagtcaattgattgaatggtcttttttgctgtgaaaatatattgtgtacaacatactttgtgcatatccacacaatttggattgagttaataaaataaagcgtttccatttcttatattatagtcagatctataaacaaatttaatctgtattcatactttcttgttaagctaaatataataataaactctttcataaaaaaaaaaaaaacaaaaaaaaaaactcatctatttctcattatgtggaagggagggggtgtcctactttctaatgtagaattgaaaaattaggaattgtttgatttgaaaaatatgtttttaattttaatgataaaaatgccatattattttcctatatttcttatttacaaaagttataaaaagaaaaaagtaaaatattttttgttattttttactatttcattatttcttaaagaaactaaaaatagaaaatgaaaacagaagcatttcctcaaaatcaaacaggtctttaagtattaatttttttcacaaatataaattttcttgtaatttttagcatttaacttattcatactaaaaaaaagttataaatcaccattttttaaattctgtgataaagggtaaaaaacaaaattccgtattatgaatgcaggtcagttcgattcgggtgatataacaacatattggaatatgatgatgcaagctgaactagctgtgcttcctattggcaccgttactttgttttttttaaggggagtgttcgatcatcattgccaatttggcttggcaccattactttttttttgggctgttcatagttggcaatttggcaccattaccatgaagtacgtttatcaagtaaaatcataaaatatttattcacaataatataatatttttcaacgttattatataaacaatatcttccgccgaaaataagttgacatatagccagaggtaagtagtggctgtatattttacgagaaagaaagtaaaacctacggttttaggagccgtttagtttataaattgatataattaattttaaattgtcaatagtgattaagatgtattttaaaatgaatttgaattataatttttacatcttttactataattataatttttacattgatatacgtgttgtagaaaagaaaatatttttataagattggcaaacagaacacttgagggtcaaaaagaaagtgaccagccagaaaagaattaatccaatcatcaaagcaactcttagatggttaaaacttgtagggccatgcttcattgtaatccacttcggcataatggcattggaagctttgttactttccctttccaacttttcttttcacttcttgccatggaaactaccacgctatattaatttattcatcttttgaagctaagtactatgttcatgtgggaagtgcattactgtatggggcacatcgagtaactatgtgtaggttcaataattacaaaatccagttgggcatagacccaccacaatgcctattattctccctaggaagatttctcttcaagaatatgcattctattcctaattattccagctacaggatttctcaccttttatttgtaacttattgatttaacccattaaagacatggaatttataatctttcgatctattttttttaatttctttttcttgctagaatattactttttcttcagtcaatggttttaaattaatgaatagtaacaagaagaaactattttcaaatgccttaaatttaatacaatttccttgcatggttgtacaataattattttctttatgtgatattattttaaacagaaaccatcttattgagggagggggggagtatttaagacacagcttaatttaggtttggtcgccattttcgtggttttcaagaactaccaaacaaagccgtttaccttcaaatctttctacaatatgtccgcatgtttgtattgattaagaggattttataatgtgaaatttagtattgtacggctgttacataataatccaacgattcaatcaatgttccctcttcgatgtaattcagtgatggttaagaattaagaaatatataggtcaatgaaattatttaaggacacatgttttatagtctactcaccaaagcaaaataattaaagaaacttgtggacaaaggtagggatatatatatatatatatatatatatatatatatatatatatatatatatatataaccatttaatcataggttaagagagtaagtttcaaggttaatttaatgactgcggtctctagctttcagggggagggaagggaggcaaatatatatttttctttagtgagcgtctaattttcatgttggaaataattgtaagtagagatttcatttgtctggctgaatgaaaaatttgctatccacgtggatatctgaaacaaatattcacaaattttataaatattaacttatttattgatatttgtttttctatgaatggaaactaatatacaaacagaagaatagaaactaaagagtaaatagtaaaagagacattagagacatcagccaataacagatgttgaagaagaaccttgtcgagccaaccagtcgggcatattgattgtcctccctataattatgatcatgcttgaaggacagatcccaatgcaaatgcttgaagttagttatcttttggataagtgctgcatatggatgcatacgaatatcatcctaatccaataactgaagagcaactgtagatttgttgatattttttttggtctaaacagtattgatatttataagcatctatgaatatttatttaaatataaaactttataaaaaaaagtaaaaaaaaaaagagataaatacacattaaaaaaaattagtacaatttatcttatacataaataaaatagtttaatgattatacagtattatcaactacataattttaaaataatcataataaaaattaataaatttatcatacatgaaaatttataattgaatgataatattttacattgtcaatgtatatgtatgttcttcaagtaagaaaatttaagtagtttttaattatttgtactcaagaaaatagataccttattaaaaatgttcaaaatccaaccaaaatgtttaaatcatcaaattgatcccaaaaagattaaaataactaaataatcaattttttcatggtcaattcgttgactgttatacacaatcaatgaaagacttttacaatgtaaatcaattaaaaagtactattgatatgacttttagttgtgaaggtcaataaatttttcatacataatagttaaatacatgttttgaaagattaaatatgtttttattctcaaatttagatcattttttttttggttctttaaatttaaatttattatttttagttcctcaattacaaaaaatgcccccctgaagtaaaaaagtcacaatgcatctgaatagtcaaaaatcaattaagaatgattaaaaagaatattttttaagagactaaaatataaatttaaatttaggaaaccagaaataacaataacttaaatttttgggacaaaaatatatttaattttgctttgaatgaaagacttagtttgatccaaagtcaggttatattttaaagaataaaatgtaattataattattaattatagtttaactattttaaattaataatcataattatacttaactttttaaaacgcaggtccttcattctataggaggcaaatttaagattgttagatgcatatttgtattaatttacttaaaaaatataattacttattttatacttataaaataaatattaaaagaaaaagcaaatcactaacatgatatagtattcgtaagataattatattttttaagtacgtgattaagagcttaattcttatatatatatatatatatatatatatatataatatagtataatataatatatcagaatatattagttctttaattagatttcgataactgaaaattgcaaccaataataaccctaattaacataaaaatgtaaaaatggcccaaaagaaattgcttattcttttgttttgtatagagaaataaaataagagtaaaaatatgtaagtgaaaaaaagataaaaaattattgttggtttgatttaagaaaaattaagataaattaagtaaaagagaaaagagaaaaataaaataaaatatcataatcgattatgtaaaataaacatatgtaagtgtttggacatgtgtttatgatacacctaactgactcatatcgatccatgttcaaggttgaaactattatttgtataaaaaaaaaaaaatcacgataaagacacgatgcctcaatgtcaatccaaacatgttgattatcaattatatatgttttttaaggcattattttgtcattttcatataaaatgtaatataatttattataatacaaaaatgatccattattattttatcatacacccttcagtcaagtgaacaacgcttctgagactagattctcatcaattctttgctatttcaactttcttttgcaccaaaatatttttatgtaagattcacaaattttaaaaaaaatttcaatacttcttcatatgtcaaactatgaatttcttataattagtacttgtttgaatacttgttcattggagaaaacacatgcacgttcttgagcacaaagaagtatttccttaattacttttgagaaaacagtcattacattcaacgaaatgattttgtaaacataatcttaatcactttttcgtccttttcaactcatttctgatgtgtttctcttcaatcaaatacaacataaataaatttcagtaacttgagaaattggtctctaactttcaatttgggatactgcacattcaaaaaaagtgaatcacaaacatgcagtagagaatagagagagaaaattgaagaataaaactacgtaaggtaacatcagacgtttgatacaaggcgggtaccaaacattaacaagaaatctgaatacagtggtagatggcagccaacagcatgtgtagtctgcctcggatgcacaataactgctcctttcaatttcagcgtaataagctatgccctatgctttagtatgcagctacctagctagtctattcccagttagctagagagacacaattatgacaataatcaaataagatgatcatttttatttgaataaataattaaattcatcttaaaacatgtgattccatgataaattaatttatgaaaaataaaaataaattcaatttttaatatgtaaaatatatgataaattaattttattattaaattttaaaattattttattattaaattataatgtttaagaactaatttcacaaaaatatatatttttaaaaatcaatttgatattaatttacaagtttaagaattaatttatcattaaattatttatgatactaatttattgtattttttacatattaaaaatataaatttaactatttattaagtaaaagttgaatgattatatactttggatttaaaaatgtattatatcaatatgatcatgtctttgttcaatttttcataaatgaataacgacatattattctctcgctactattaatcttcttaagattttatgaaagaaacactgaataaaaaataaatatttaatatttcaaaatatttaatatttttatttaataaataaaagggttatatagtaaaaaaaatgtcgctataaaatgatttattagaatgattctttataaatattactaaatgtcatatttttcataattcttcctaaataaaatcgacaactgtaacatgtacaagtctgaagttgacaacttaatcaaaatagagacaaaactgataaaagacaaaagacattataaattagctcacctatctattttcctgacacacaaccttgtcttgaccaagcttggtagcaacctttgctctgctgatttttatctttgcaaacgtctgtaaccctcaatattagctagctagtgaacattaattatttctgtaaggttgatatattcatcaaaatttgaacttatataatatagtgtcagttagctgtttatattttataataatgggtgtgaagaggacatgctgatgcaaatggctttataaattgagcatgaaagattataatctccaagcttgtcttgaaatgatttaccatattgactcttggtcaaattgaagatttcaaatttatttttgttttactcatataggagctagcgtttggagaccatttgggtaagaaggtgtcccccacctatggtggagacacgactaccacttaaaacaagtggcagttgaagttttcaacagctgaatcaatttagagcatgctcgtgtttcaaagaattaaaatatgttggcgaaaaagttttaagagataagtatgtaattaaaatacagaatgaatattgaagatgaaatttatatgattcgtttttataagagtgttctaactttaaggtacagattaacaaaataaaaatagtattatacaaaacatttaaaaataatttaatatttgatttaaaagaatttaaaatgtttaaccataattaatactcttggatttttcattaatgaaatcattcttttttttagatattaataagaaaatcattcttgaacatacaaaaattaatttttacattaatcaacattaacttatttattttcttaaagttaagttatttatttatgattctaattgtatatgttaatgcgaacttgctaatttaaagcaatgctaattgatgatttaaattaaataattaagaaagtaaaaaaattattattacaatatattgtgagatgaaaacgtttaaaaaaaataaagttaagatgcaaacttttaaagatcattgataaatctacaatatatccaaatttatagattttttttaacatgtttcaaagcattaacttggtggaatattgtgagaaaaaaattcatattatatattttttgtgattcatgatttcaatggtttaaatgaaagaaaaaagcgtgaatagacttctcttttcttggatttttaatgtagggaagatgaacaatagtgagaagcttcaaattttatatctcctctttgtcaaactctagaaatgtgattgaagtcatcttggtccccgtgaaaagcttaaatatagatctatatttttcatgaagattgtttgattagattcaaggtggaacaacaaaaagttattggtataagtggtttgtcacttaggtttcttaatcaatatttgagatttaattttgacttgacttgaatatgaagtgattatcactttatctaaaaatagaataacgatggaaagaaattatacctcttgattatatataaaaaaaaatatatagaaaaaatatacctcttgattcaacgcggaacatagacaaaattggacttaaagttgaagatgacgcgttgtcctaccaacatcaacgcaagtgcaatgtttaaagaaaaaatatagatctatatttttcatgaagagagtttgattatgattcctctacaacatcgtcaaaaacaaatcgacacaagtgcaatgttttgagcatatttagagatgcagatgttgaattgtacagtgtttgacaggtgcaaaacacgggcctagcgtgaacggagtccctgcatatcgctactggacgggcattgttcattgtcgagtgcgtaatgttcactgcttaacgttgaggcgaactagatttgtggaaaatttcatgtctggcgcgattcgtctaagaaattatatcattggggacaatttgtttgatcttcctaggactagaagcgagaaagacttcgacgttcgaagaaccattactagtggtagagaaaaaatgagaagagaaaaaactaaaaaattatagacaaacacaatttgtatatctcaataatttttttccttttaattttttaaccaatactcttgggacatgggttagtatttttcaaaaaattattactcatttttttttcatacaaagttttgataaacctatgtttgccctgcagacacctgtacaatctcctgatctcctctaatatgacattgacatgttgtttaactcaacaaactgcttctgtctgaagttaaaagttaccaacgaagagttctgtgcctaggactagctgttttcgtagctaaaatctgaaaaggatttcctatctttgtctcttaaaacacatctgtcatcgctttatgattcctctcctaaaataatttttattcctatttccttacatactgtgttcatagtagaataagaaaatgggtcaaactcagatatagctcgttgattttcgaggcttgagtcacaataatcactccttgatgggtatgtaattcatgtaaaacagaaaaatgtgaagtggagattcaccttcctctaaaaagggtttaatactgaatattgataaataaaaaaaatcaccttcctctaaactccaaaacaatctcagcttccttggctaacaactacattctccgtacctcatcatgcacaaccggcctcccgcctacattcctagaaaggggaagaaagtgtggcaacataagcgtgaaacaataacgtggctataaaaaccaagcaaacggagatgtcattgcattcatcacacacaatcacaaacagtaaacattcaagcaaaatctcatcctttctctaatggctatctggtttgtgatccttcttacattctttgccattggtgaatctcagtccacaatgtcattcaaccaaaccgacctgcaggtagccatgactgacatgagaagtcggtcctactatggatttgtcatcctcctcaaaatactcaacagccagcccaactcactgcaaaacaatgatttgacattcctaatgccaaatgatgatgaactatctcaattctcaatagctctagaccagcttcatgatttcatactcagccattctattccaacaccattagtgctcagccatctattacattttccaaatggctctgtggttccctctagcgttccaagcagggtgatcagcatcaccaacggtgggagaacaggtttgtttgtcaacaatgcaaggattgtcacaccaaatgtgtgccaaagctcttccataagatgccacggaatcagtgctgctttgacatttgacaacatggtgccttcccaccgagctccaaaacccaaggagtctccaaagaacagcagtgtgacaaacccatccttatctgtcaaaaagatgaatatcccacctttccagtaaggcgagaaaaatactttgcccttcagctgtaatgtcgtttcgttttatcaataacataatattacttttactttgtctccacaatgagctatttggcctgtagtcctgatccaactcactcaccacaatgttaaacatattgactaactaattagattccacaaatcaagaaacaatcaataatttgtcacaaatgcgtattcatacatacaccgcatagaacaaaccgaatttcaatctgagttaagcctttagttactagtacctcttcgatctacaaaaggcttacaatgcttgaaactaatggaattagactaactcttcatcaattgtgcaacagaataacattgctataatatgtaaaagattataacatacactgaacccgtactcatgggtttgttctgaaagggtgggactcattagattgaccgtctgccttcggaggaacactgtagagaagatcatggattttggaatacatcagcattgaagatgggtcacccccactactgctctgtgatacacgagaagtctcctgcaatttgatcttctcatacagatattgcttctcagcctcagcctcacttaatttttgcttcaaatagttgctagtatattcttcctctgatttatctgacttggcaagagcaatcctctggagccgctctgcctctcttttagcctcgttagcctttaactggaacatatcagcctctgcatttttaagcctcacaattctctccagttcttcaatctgtaacttctttttttgcgtgtccattttcagttctcctgcttctctggccttgtctgctaattcacgttcacaagcatcaaaagccaagcgagctttcttgaacattctcatcttctcatcagctactatttccatctttcttatagcctcatgcaccacttcagcaattctattgcatgcctcctggggagcaatcagccttccactttctgcattttccaggctttttggagagtccagatcaagctcttcatatatgaaaagcattggttaaaacaagaagaaaggataattaataaagtaatagaattaattttattgattatacatgtttttaactatgcaaatcacaatttcattcctagatatcttcaaattcaggttttaatgaagagaaagcaggaagtttggagataacctcaaagtatagtctaaaagcttctttttttaatcattcctaacacagttttaatgaaatttcaacttttcagtacaaacaaatactactatgatatgaacatagtaaatgggcccaaaaaaaaaatgccaaaaacaataatgttgtattcacactaggtgcatgtgcatccatgtgcgtgtagcctatgtcaaggcagaaactttaaaactacaatttgcaggtaaactagaaaacttgtaccttggaaaaccatcaatattgccctgcatgctgccttagattccactttcccacttttcaatttttccttgagatcatcacacttccaataaagtttcctccctcgtgggtctttactaccatgaaagatcctactgacaaaatcaagttccctcatcaatgcctctccatcccatgatggtgcacaatgctggaagacatctttaacccaacccagaagttctgaagtcctgttacatgcttgacacctgaaaaccatttcacttggccctgctccattctttgcagaagggcccatacaaataagttgctcacgtatggcacagtctgtgtgagtccaatgagaacacaaatcacatccaatccagcggcatgtatttacttcaaagtcaaacttgctgcagataacacacatgcaaagattgcagaaaccattgccattagtgcacgtctcacaggtacaatcttcagcaggaagttggttttggcaagcaatgtttctgcatctcttgtacacaaatatttcaatcagtgatgtttgtgatagactgatgctaggatgtaaatatccctgaattccagtatttattgcaacaaggatttcaagctgtacacgatgtgctcttatcaatgtcttggctgttaaatcagatctactctgaacaagcttttgcaaaatgaaaaattcttctctatgctgtgagccattccctccctcaaggataactcgaagtccatttttcagttcctcaagaaattcgtcaggtaaaagatgcattttctcacatattatatcaactcgttctcttgcaatgtcctgaagactaattttgtctgcactagaaacacggcgaataactaactgctcaggacaatccatctctgcttttccattctccatcttctttgcagcaattgcatcagcagtaggccaagtttctcgagaactggcactttcagtaggagattcacggagattgtcagagtttgatctaggctcctcgggagaaaggcggggatccgaagaaactagagatagagaggtttgtagtcctccaacccgtgactgctgtggtggagggagcattttctttttctttttcacaaaggcttctgttttatgttagagcctggtgacctacccaaaaaatatttacttagtcagtaactagctaaggggattatataccactgcacatgattatcacatattctttgttatgctacaaatagttaaatactaaaatgttacaaatgagcgaggaacttgagaaaattcaaaatctgctaaaagttgcaggcttacagcctttcatcctctgcccccactccacataaacctccaaaacacagaaacattacaaaagacaaagcaagtactagagactagagactagagactagagagtagagagaataattatcaaactatttagtaagcagtcaggccctaatttttccacaaactgatgccaaaaaacaaaatacattcgaaaaaacatattatcataatctacacaataatcacaggaaaatccatcagtgataacggaaaagaagaaaaattagaaagtttaataccagtgatttcactcttgattctattgtgcaacgagcttcttatcaaatgaagaagctcgagagatatgcaatctctcacagaaactatgatgtcacacaagtccactcatcaactcaaacaatagatcaaatgataaagatgcaagttgaacgacccagcacagaaagttgacattaaaattgagacataaaagtcgctgcaaaggatgtttcaaaggttgatcgaaattcacgcaatcacagcaaaaatatccttgaaaaaataagaatgataatttggattaaaaaggagaggaaggttaccagagagaggagaagaaaaatggaaagaaggctaatcgattggagtatgtatcttccttgttcacaacttaataaaagaagaaatgggggatcaaagaagagaaatgggttggttaggtcaaaataggaatggtgtgtttgcccattttaccctgaccggttcagaccgggaaaaggacggaaccggcgaattaagaagaacacgacaaaatagaataatcaaattgattttatttttgtttgaactgtggaagtgggaaggaaggtggtctggtcgtgttttccaacgatgacttgttcacacggttgactagcgttacatgtttactcattcataattgtgccatctttttcttgttgggcggaagcgttaattaactctgtcaagtaccgttaattttccaccaaattatgccaagtcattacaacgctcctaatcgaaaccattactcttcagtttcattatgatgggtaagtatgattgaaacaatttcaatttcattatactattactgttcagtgcttctttccttggtttctgaattatcatgaattgtgaatggtttgcttttataaattgtttactttcgtttatttttttttattttttttcatcttttgtcacgaattccctttaccttccattatgattacataacataataattgggacccggaccaagtttttcttcttctaatttttatatacattaattgtagctaacagtctatttttacttatgacatcacattataaattacaaagtgaaacaaaactctatattttttatacatctcatctcatttaatataaaaaacatcctcttgaatatctttattgatagattttaaattgagattttagattattttttagtaaatcttaatgtcacataaaattaaagatctcttaagatattttttttaatagtaaatctcattttaaaatcttagaaaaaaaataaaaaaaatttattttttttaaataatatttagatcttaataaatcttcttcaactcacatatatgcaaattctccgctcaggaataccaaagtcactgcaatgacatcaaattttttttcgcttttacctgctgcaaaattagctaagttgcagttatatttgtttattgaatgggtttcctcaaactttcccttgaacaggcctgcgacatttggagaaccttcagctttaacgttgatgcaatcatcattgaccaccacctcagtccaaaactgacgcttgccatcatttttctcataataatctgatgttttggcttggctaccacgaagaatagattgaggaacctccttgtagagtgtccatgacgaagcccgagaatgccatgtgggattagaaattagctgtagatatgggaccttgcatacctgcatgtatgacggatttaggatcctgggttagtaggttaatttattttaaaaaataaaaattgataattatcattatcatataggataattgggtttaaacacgaaaataagatatataaaatataaatttttaagatcaatatttacattttattaaaataagagggtacattaatttactcacatgtgaattggtaaggaggttcaaatacataaaattagaaaatgcaaaatataaaattaaaaagtataaaatataatattttaggacctatgttagtgattttattaaaataaggggtacatttgcccaccctgccaatgtagctccaccggtgcctgcaggtatcaaaaacttaaataaatgtccattttacaaccaactaaagtcaaattcggaaagagtcataccacgttttccagctctgcaagaactttggttggaaatatcctgtgagccaaagatttaaaaaaaatgaccaagaagactggatccatccttttccagtaaaccacaagatgatcataatagtgtgtgcatgtcttatgtctaagcatttaaattccaacacaactatcatgtaacaaagacccattcctctctcctttggcattatgaattttcaatattagttagctaaagcctcaaccacctaggagaaaattgaaggagctaaaggctacatgcagatagcatcaacatgagaaattaagcaaaactgacttgggcatcaatagaaattttggtaaaactgatgtcaagcacatcacacatcaatgcaaaaaatagatcagacaatcgtaaaacaatggagcctaaaatacatttatcatgccatgcataatcattcatcaaaaacaaatttcatttccaaaacgtgatgtaaatcttataagtaagcatagttattgttaagataactccatgagagggcttaatttatgaaaaatatatttaagttcagcacacaagattcaaaatatatgcactaaattttagcatcgatgaacgctattgattgaaaactaatgaatgatttcatatctaacaatacccttccaattattctaatattttatgttataagtactatagaacatatcatttgccaaaaaggttaattacaggagtaattattaaaatttaacttattcaattgagacaagaaaatataatcaaccttaaaatactaaagaaaacctcttcaatatagtcacatcacatataatagtttttgccttcctccattatatttctcctttatccatacacaatctgtaaaataggcaatttggcatgttgctggaatcttgtaatacatcagcaccacaatttagattattccaaatttccattgaccatatactgaacaacctttcagggaaaaaagtaaccgaattcaatgcatttacccagttgttattttatatcattgcctgataaatgaatatattgggggaaatatatcaaaatgtgttataatcagcatagaacttaccatcaagccattgttggctggctactttttcagttagggatgtggatggatatatttgtggataaaatttgtaatatatataaacagataaaagatagacattttcttttactggatcaaagatcacggatttttttcaatccacttgataaacacaatgataaatatctaaataagtatggatgaataatttaagcaatttttatttttgttaataaaatggtagagacagatattaaagtatatcagttgttttttattattatttgtaagaatcaaacacaatcttaagaaatttataacaactttcacattttgctcgatcacttgagttaaactcgttgatacattaaagtatttgttttactatactcgttaaatacttgttgtaataaaattatttaagtatttttgttaaaaattattttggatttgtgaaatttaaatattatattttattagcttttatttgaacttatagaattgaattatcttcgaggacggttcctggaatcttttttcattcttgggaatgttatttccaagaatattagattagaatgatatttttggatatttcaagaaaaatacatttgtttaattattaaaatttgattgagaatcttttttatatttccataaatatttttaaaatgtgtttggttcacattatttttttctaaaaatgtatgttatattactaaaatattttttaatatataaaataactcattatatacacctacacaataatacaggagatcaaatactgcagtttacaaataacattgaagaatcttataaatttttctaataaatttcttaaccacattttactattaaagaaacgaatacccttgtaaaagacaaacaacataaaaagacacatacaacataactttaaccaaactccaagtaaaccaaaaacacaatcgataaactgtcttcatatcaaaaaataaatttaaaaaacaactgcaacatacttgtcttctgtctttaaattcacaccctttgttatcaaagttgaacagtaaaatctgaaatactaacttatatatttagatattatattgagggtataatagaatttttacataattaatatgattctcatttcttaaaaatttatattttcatcctcttttcatgagaatcatctcaatataatattaacattaacatgaatatctcactttcctaaaaataaaagatatgaaagagtatttttcaattacctttaaataaatgtaaaaatatatattttgatctcctcatttctcgaaattcttaaaaaggatttgaatgaacaaacactccctaaagtttattaagttttgttttgaattcatgggactgaagcattttaatatttaaatttattaaaataaagtataataattaatataattgtgttgagtgtttaaataactttagttttgacctttaaattattttttaaagaaatggttaaaataaataaaaattatagttaaagcatctaaatatccacatatatttgcgaatattaaaaaaattgtaagatggtcgtgagtgactcttgttctatctccaatgatgttaagatggtcctcttccatctcctccgccacacccttcacctcttcaaccaaccgtactcctccaaagacacgtcgtcgttttcgggtggagtcgttgaagcggagttcgaaaccagcgtcggtggagttggtgaaggaccccaataaggacttgtgccgcattctccgaaccgaagccgccatcagaggcgttcagaacaaggccaagtcgtcctcccacaaacagctctggcccaaggcccttctcgaagccctcgacgacgccatcaaacgctgtcgttcgcactccgctctcgaggccagtaattaattgattttaggattaacattttctgtgtctgaactctgaaacaagtaattatgactgattattattattattattatcatttgcagatttttgcactccttcgtaagcaatactggtatcaaccacgatgccaaacgtatgcaaagcttttgatgatgcttggcaagtgcaggcagcctgaagaggcttctctgctctttgagatcatgttgtctgaaggccttaaacctactgttgatgtctacactgctcttgcaagtgcttatggtcaaagtggtctccttgatcaggctttttctactgttgaagatatgaaatcagttgttgactgcgaaccggatgtatatacttattctattcttatccgctgttgtgcgaaatttcgtcgttttgatctgattgaacatgttctagcagagatgtcgtatctgggcatcgaatgtaactgtgtgacttataattctatcattgatggatatggtaaggctggcatgtttgaacagatggatgatgcattgaataatatgattgaaaactgcaactcccacccggatgttttcacgctgaattctttcgttggagcatatggaaatgctgggcaacttgataagatggagaagtggtatgatgaatttcagctaatggggataaagccagacataacgacgttcaatacgatgataaagtcctatggaaaagctggcatgtatgagaagatgaagactgttatggatttcatggagaagaggtttttcactccaacgatcgttacatataatactgtcattgaggtgtttggcaaagctggagagattgagaaaatggatcaacactttctgaagatgaagcatctaggagtgaagcctaattctataacttattgctcacttgttagtgcttatagcaaagttgggcgcattgacaaagttgactcaatcatgaggcatgttgaaaattctgatgtagtattggatactcccttctttaattgcataattagtgcctatggtcaggttggcgacttaaaaaagatgggcaagttattcttggctatgagagaaagaaaatgtgaacctgataacatcactttcgcttgcatgatccaggcatacaacacccaaggcatgactgaggctgctcaaaacttggaaaacatgatgatttctgccaaaagtagctttggtatgttgtgctatttgctctttgataccttttctatgttttctatgcttggtctgtcctattgtgcttggtaggaaatgcctaatctaataagccttccttggtattcgagtgcatgcaactattgtgcaggacaatgttagatgcctattagtgttagtctgtaagtgatatagtcagctagttaggttgggctgagactggcaaagaaataaggcataatgtaaaaatcatgcaaagaggctctataaatctatatatgctgttaatttatcaggtgtattcatcttctcaaacttgttatgcgaaagtagcagttatgcataggtctaaagggaggggggtaagtgggttgagttaggcattctgttttgtatcaatgtaaatgaggaattgctgaggcatgtgggtggaatatagttttcttctagtccttggaaggcagaccatttgttctctttgcctttatatattttcttgttttctgcaatagtaatgcctgagttttgcttttcactagttggttcattatcccttgaataatttttatatcatcattcatcaacacaccttacccaatgtttgatcaacaggcactaagttgattggatgctagcatagataattgtgattcaagacttaacaattctactcatggggatcctgacttggaaatctttgagaacttcagcaggtaagcatagattcttcataagtacattattattctgaaggaattttttttacccgtcaatttggaagtcatttactgtattatgttcagaaaaacatagcttcctagttttattcatagttagttggattaaaaaaaaaaaaaaatccattaaaagcattgttttcactgaattctctttttccttcttatagctccttatattctactatgcctaaaattcacaagatagaagcctgtataaactgaatgtatgcttaagtctgaaatgtaacccagtaccttcaaaacactttcatagtcatcaaaggtacctcaaaatctattgaatactgtatcaagcagccaattgcagaaggtatcctttgatccaaagaggatgcctatcattcaaatagaattccttctcttggggagcaccctgttttgttcttttcaaaggaagttgttctttcttttttgtttcatattgaaatcttatgttttggattttaagatgattcctttactggttttcaatctaatcagtataggtgaatctctcttgagcatggaaattttttagtctgtatgtcacctgattttatcaccagtttcaacttttaattgtactaacatgcctttgtcatgttaagtacacaattgtttgtcattgcctgaaaaatgaatcaggaagaccccaaagtttatttcataactggttggtccaataactttgggttttgtttgagggtaaaaagtgggagaattttttgggtagaatttttaaggaagtgagttttatagaagtaatatttctttaggggggatgattttttttaccctattattagggtgaaacttcacccccaataattattgttctttctaatttctcattctcttgatcgccaattgtttcttcccgtgtatcaaatgcgtctgtgctgccggggtgacttttaccaatacagtcttttgcatcatcacccttaaactttgctgaatttggacatttgtgtttcctgcagggaatctatagatgatatagcattggagtgcacgttgcatgaagatataaaaaatgttgggtttattatcataatctgaagtgtagtttcaatcatcaaatttggcgtcctgcataccatcatgtatgcaactcagtcaaccaattgggttgggtgttcaattttgaaagacagaatacgataccagtgctttgcagtctatacagctcatacccacctcgcttaccgatgttgcaatgtgccgtatgaatgtgttgttgcagcccaaattgccattaataccgtagcgtatcatgaaaaatgctagtaacactaacatttttcttttgacatactctcttctattgggtgaaatttatgttggtcccatcaaatatgcaagtctcttctcatttagtgggtttcgttccaaaactagtaggacctacatgaattttaacaagtagaaaatagtgttacaaaggaagtgttggtgttttatttgcacttttctttataccactaaaagtcctcaaagcaaatgagttgtgcaccaagtaattgcatagtttgtcaataatgtatgaagtataataaagttcaaccattgaattgttaaataaatgtgcttctctgcccatggatttgtcattacttgaatgtattattactatttagtgtaccaaactcttttttaaggtaatttaaaattattttctgttttgagggtaacgtggcataagtcatcactctttgccaagaaaactcattttcattgccatgaatacttgactacaatgtcttacggagggagaggatatcctctgaggaaagattatcaaattattattaaatatgttgttaattttttggattaatattattttgcatgctcacaaggaacacaatacatttcatttttcttcgtttatgcttttttttcttcataaagcagcacaattttttcaacaaaaaagaatgttgttcataacatattcattttgatcattgatttttttttctttatgcactgaatgcctagtttgcaatggtcaaattgagagggtcatgcaagcacaacacctttcctggtttgtgtctatttgtatttataatagggtctatcttgtacaaatttgcacgagtttaaataggatagaaaaatcttatgcacacttgcacaagtttgccctggttaaacatcattaattattcactttccatcatttttaactaaccgattaattataattttttgaaaaacaactatctctcatgtttattattacatatgactctttaaaatttctttctcttctcataaaaaaaatcttaattttttgtaaagctcctgttaagtaagtattgcatcgtagcaagaaataaatgggtaacgtgattcttaaaacaatgttgttctccagggagaagagaaacaagaaaatgactaagagaaaataagatttccaggccatgttagctaaaaggtaaggaagtaaaagtgtatgaaagattgccacaaccatgctctttttatatgcaaggattacttgtataaaccattcttctataggtggatgtgttgtttggtaattggtatataatatatgttttcttttttgagatgggacggtggaaaatttccatacttggatggactttcaattcatcatgtaatactctttgcacttgtgtcttttaatcaatgcatttttaatttgcctaaaaaaattacgtacattgtgtggtttgagttttccatacttttatcgaccttcaattcatcatgtaatactctttttatctgtagagatggaatacttgaatgcactttatgaatgatctcataaatttgaaaattcatttgcctatatctttatcaacttttatcattaaatcaaagttgagatatgtttataatctttgcatcccattctaatttttatttctagtccattttttggtgtggaggggagacagtaagagaaaatattgttgttgtaagttgcagacgtttgtcccacaacagagagggtcattgccgaagcccataatgttggcgtaacaatcatcgaggtcgccaatttggagatagtcgcaaccgaagcagaagtcctcgatgatgtcgatgtcggtcagggtgagccgctcttggctgaagtagttgtgggtctgggaatcgtccagatagtattggttgtactcgcatggatgtgtgagtgatgaacaacgtggctcatttcctataaccgatttcagttgagtgtactgtggagcttgacattcaacttcctaataagatgaggactccactctattatagtttgcatctttctgcgggtaacaatcaatgcagttgagttttcactgagtccaagttatgttactccctgtgtcataggcaagtgtatggtccttctttggtgtccctatatcaaccaccacaacatagttcaaacttcaaagtattaacaattgaaacacgatagaatggtaattcctcccatcctcattgtcacgcctaaacctggactcgatgtaatctactctgcttgtccagattcagcacatcaatggctaactaagctctcagattaagatgggaacatggcccctctttgtggaccaattccattgatccttttcttttcaaacctgaagcaaaaaattacaaacaattgttataaatttgaatttaaggggataagtttgtgtctagtttgtgatggtcaaattgagaggtcatgcaagcaaaacactttcctggtttgtggctattagtattcatataaagatttttctatcttgtgcaaacttacacgagtttgcacaggttcaacataattaattatctactttccatcacttttaactaacctattaattatgattatttgaaaaacaactatctctcctacttattactacatatgaactctttaaaatttctttatcttcctacaaaaaaaaaattaacattttgtaaagttattattaagcaagttttgtatcgtagcaagaaataaataggtaatgtgatttttaaagatttttttgtcatactattatagaaaatcttttgttgtgcaaaattttgccattttgatctgattgaacgatagtgagattgtcaacacaacaagtgttgtaggtgatatcaccaagaacgacgtcactgagaatgatggttttcaaacactaacttctaacttctccattgcaacccatttctttcccttctttgctactacctttctaacgttgtcattgttagtgatggtgctttcattggtgggagtgattgtagccaatttgtgtccgattgcaatggtggtgaaggggtgcctagtgaagggtacttatgtctttacatgtcttttgggaggggcaggaatcaaaagtccagatttgatttaatggattcaccaaaaacagaacagatttattggaccaaagtacaacgcataatcttttttgtggcaactgttccattgaaataattcttatctcatgctgccacagcatatttatccaaaattattatggtatctatttttccccaagcaaaagaaacacttcttggttatgctggatgttttataattacaacggaaaggataactacaaatattactttggtaaaaaaaaactaaatgttactatcaatacccatgttcttcaagaatacaatttcacccgtaagcaatgttaaaagaaagaacagaaagtaacgggaagaaaacaaaaatgtccacatgactgtcctctcacttctgaccaccagcctcagttggttcaaccacctcagcttctacagtttctggggtatggggccggattaccgtggactggaactgaccaggtgtggaccatttaccagtgagagccatacccatcatctcatatatcttccctccaagttgtgctggattatcaggctgcacaccaacaaacaaccaaaagacacaaagtttaggatttcgcaatggaaacttaaataacattcaataatatggagccatgagtttaccgtaaaaccactggaaaccaaagcagcatcatacaaaagatcaatagctctgagggcatcttcatcgtctggatttgttttaaatgcatcctgaaaattatccatcaagattacgacaccataatttcaatttgtaatcattacaaagaaaagtggggattatctatttatcgtacatccaagttcctgataatagaatggtcagggttgatctcaaacacccttctgctcctcatgaattccaaactggatgcatcacccatagattgtgccttcatcagcctgcagtaagtgtgattaatactgaacattgctactcaaactttcaaaatacataatttaatatcaaagaaaaaagatgacaacctttccatgtttgcagaccaaccaaattttccagacgcaaggacacaaggtgaagagctaagccggtttgaaatttgcacacttgcaactttatctcccaatcgtttcttgatccagtcacatgtttggccaaattcctgcttcatttccttttccttttcctcattcttatcacctgcaaaaagaacaaactatcaacatcaacaacatctttaactcaagctaattggggtcggttgtagatgaacccaatgatagatacaaggaggttttaaaaaaaaaagaagtggaaggggaaggggaggggaaaggagaaataagataaaagaaagaacaaactatacgtaacaaatttgaacattaaacaagaaccaagctacgaattcacaccattgtcaacattaaaattagctcaaaagagagactaacaaatatttggttaacaaaatgcgagtttatgttcaatcaaattattgaaagtttaaagaagaaagaagttaacctagatccaaagtttaaagaagaaagaagttaacctagatccaagtcttccttgctaatgtcaacaaaattcttttccttgtatgatttaagattttgaatagcaacttcatctattggatccaccaaaaacagaacctggaaaattacattacaaaaaacaccaatatatgtatattaatcgatagaactaagtactcaaaagttaaaaaactaaaaaaaaaaagcttatacttcaagatccttctctgcaagtttctccaagaaaggtgtgttctttgcactagtcacactgtcagcagcaatgtaataaatatccttttgatcaggtttcatgttctcaacatattcatccaagctgatcagttcttcatcactttgggatgaggaaaaacgaagcaatggagcaatacgtttgtgattctcacggtcttcaatgcaacccaattttaagtgtttgccgaagttctcccagaacttctcatagtcctgcatacagaacaagtcagtcagtaaaatttaacaggaaaaaaggtcatccttttaaaaagagcttaagagaagttatataagaaagatcaaaagccactgataggatatatataaagttgatatatctataagataaagccacctcaatttatcctagctcctctacaacttaaagaaaaaatgaaagcaaactgtatacagttaacaattttcaaaataattatatacctctttgttctcactcatggatattcccagaatcatgtcaaaagctttacgaacaagacgtttcctcataatccgaaccttcaagcaccacggagtaaaaaaattaagcaagatgaaactggtaaggaattttatgagtgtatcctaaacgagagattcagatgtaaagtgtaagaatatgtgtgttgccctatctacttactatgcggctctcttgaagaatttcccgtgacacattgaggggaaggtcatttgagtcaacaacacctttgacaaagcttaagtatcgggggaactgtttaagcaagcaaaacattagtgaaggataaaattatcagaacaccatccagttattcaaggttgtagatagcaaagtgcttataccagttctccatcaaaatcatctgaaatgaacactctcttcacaaaaagtcttatattcttggtcttgggattgattatgtcatcctttccagagggagcgaaggcaggaacataaagtatagatctaaattctacctcaccctgcaataacaaacatcatccacacatttgtcaataaaaataaccaacacaatattggttgtcaaattaacactatgaatctcctatggacattggagaaaaattgatgttctcaagctatgtttttcagctgaactcaacaaataaaaaaatccactacacacaacaagatggcacttgagacaattaaattcttacctctgtggtaaagtgtgatgatgctaatggctccaggtattcattaaaagttttcttgtagaattcattgtactcctccttagtgacttctttaggattacgaagctgcataaatagagtaatgccacaatcttcaatcgagtaataaattttcaatataattgcaaatcatggaattggaaatcataaaactcacccagattggttgggtgtcatttgtcagctcccaatcccagtaccgctcaactacagttttagttttcttctttttctgtcataacaacgtgtcaaagactcagtcatgagtcaatgagtaaatttgcagaagctacacaatcacactttcacattcaacaaaatacttgattcagcatatatgcagaacaatcagattgtcacctcagtcttatcatcttgatcatcctttttgtcttcagctgtatcgtcgtcaacttccacctggaatgagcccaaaaattaataaaagctcaaaaagtcaaattttacaatctagaagggacgaacttaacttaaaatgaaaataatacggtcatcgatactgctatcaaactgaaaaaatctggattgtagagccatacttctttggtgtatcccttttcctgccatgtgtatattggaaatgagacaaattgtgaatagtttttcacaagcttctcaatccgctctggatgagcaaagcctttgtcgtccttctgaaagatagcgataggcaaaaagaaatcacatttttaattaatctcaggaataaagaaaactaaaaaatatttgatggtcaaaaaaggaaattatcagcatgccttaagatacagtgtaaggcgagttcctcttcgaatcagcttctctggatctgtctcctcagatattgtatacgagctagcatttgcctccccttcccaaacatattgcttatcagattttggactctttgttgagacaaccaccttcaaacaacaaaaaattatataaataccatattaaacaaaaaaatttaagagcatcacatatttacttttacaaaaatgcatacccgatcagaaaccagaaaagcagaataaaatcccacaccaaattgaccaattaagttgttgtcaccaccaacatccttgctatcctttagagccttcaaaaactttgcagttccactttgagcgatagttccaagacaatcaactagttcttgcctagtcataccaatgcctgtatcactgcataaaaaacataagttgcagcaccaactgaaatgacaaacattaatcatattcatagctatttctcttacgtaatactgatgatcccattatccttatcagcttgaattcggatatcaaaatcaactgcgtccttcaacagtccaggctctgttacactcagaaaccgcagcttatccaaagcatcacttgcattgctgcaaatgaaaatgcatagataaatagcttgacaatgcagaatttcataacattcaatcaataccaagacacaggcttctctatttttggatttttcaactatctttttggaaatacttttccttcaattacttgcagcatgtctgcaggaaatcatacatgatacacaacaaccacaacagcgcttaaaaagggtgtagataaatatatttgcaccaattaaacacaaaacaaaaatgctctatcagacaagaaatatgcaaacactactcaagagcaaaagagcatacctgataagctccctaagaaacacttccttgttactatataaactgttaacaatgaggtccatgaggcgactaacctgccatagccaaggatgcatatatattatcgaaagttaagttatgctcatgacactagactagacatgaaatagaatacctcagcttggtactcatatctctcggcggccgctgaggaagaagattctgcagcagttgattcatatcgtttgccaaagaacaaatcccttttcaagtttgaggaatcaattgtggatttatcagagctcataatagaaaaccatctagctgctttggtgtcattttcacccacctgtgactgtgattgtcattcgagaacatcagtaagttacactacataattaattaatgttatctaactgaaaaggaaatggattggtagcggcgaaagaatagtagggattatgatatgaagagtaatttgtaaagcgaagagagaaagaaatgagcaccttagctgctaagtgagaagaggaaatgggagcaagcacgttccggcgaagtgcgccgccaccgtagcgcagcaaggcagagcgagtagtagtagaagaagagagtctctgcatcatattgaattgaattgaactaagagagagagagagagaaactgcgtttgtttgtaagaaaatatggtagtagggttttagaaggggtttgcttgcttcgatcgaaaaatggcgttttggaagcttctcgatgcagctcgtttccacacttccctcaacaatatatttcccgtttcggtttattttcttttttcatgcctcgtttcttttttacttaatttgtacgactattataatttgtttatcctccttctaagtatataagtgttcggaattctttattgtaattcaatatatttttcattttcataaaattaaaatatattttttaactcaagtaagtttagataaatttaaacttataaaaaatattatattttatatcaattatatatataatcaacataaaagatattaaattgttatattaattatatatatgtaaaaatttatcatcctaagtttgaatttatttgaatctatattatataaaaaataatacattttaattttatgaaaatgaaaaacgtattataaattttacaaaaataaattttaaacatttttcatattcaatgaataccaaaaatatattttagcataataataataatatttataaattacatttttaatcaaaactttgattgcgatcatattcttgtctcttgagagttgagaccaattttctttcaaaataaataaaacaaagattggaaaagaacatctcattgataaatgaccatggtgggagaaaggaggctttcgcaatggcccaggagtccaggcccgttagcattcagccaggcccgttgtcctgtcggttatatgtcaagcagacaaaacttggttgggtggtggatggagtctatgattattgaattggaggcataagtttttcaataaaagttcgaagaaataataaaattagaaaaaagaggcaccaacaatacttagtgtacagtaaaaaatcgaaagagtgaaactcaaatattgtatatgtataaatgtataatgcatagagttgaaccaaaattggaattgcgaatcttatataaactattttagtgtaaaaggcttgcttcctatcatacttaagaatgtaaaataatccaaatgtattgagattgtttttttacaaacatttagtataacagaaaaacaagccaatttgaaaggctatcattggtaggcggacaagtaagcatcccagtgtgattggggagagaataaggtaggcgctgtgaatcaggctattcgtggatatattgaattgttaacatagatctattaagagaatcagagaattactgcacaaccttaaatcacatacaattttattcaatcgtaattattcaactagatcctcaacgtctaagaattttcttaagagttgtccactaagcaaagttttcaatagttttagagaaatatctttggtgcacataaaaagattaattaatgatttatttgtagatatttactcaattcttgtaattgattgtacttaatgaaaaaaaattactgttagtgatgtatcttaaattttgaaaaatgtttaaatacttatgaataaatatcagaatttagttgttatttttaaattcaaaatattgccaaatatttttttaagaattataaatataataagatatcatcagtatggcatgtcatatagcttctacctttttaatttctgaagaatatattaagaaatatataagtccaactaaagccaccttgggatactgccaaataaataaagagcacaatataattgtcgtgtttgtatgtctcaacgcacgtgtttagacataattataagtaggtgatttgatattggagtagagcatgataatttcatatttctacaaaatttatttaaaaaaaatgattttgatcagtatagcaatcataagtaaaaaaaactaattgcaagtttggaaatgactacttttgaggaaataattactgcacctattttagttttctcgatgaaaataaatactatttctttaaaataagttaaactaaatacatataatttattactgattttttaaaacaatttaaaagctttaaactttaataaatatacaataaaaatgtttaatgccttttagctgtcttaaaaacatttatttttgttttcaatgaaatgcaaaataatattggattaatgtgaatggatcaaattttcaatcttatgcaaaaaagaaaaattatatcagtatatcactaaatcacagttcatatatgcgtgtatgttactttaggtagtacttttttgtaataaaagtattaaattaaattatacgccgataagattattttaatttatatcaatttgtcacttgataataacttacatacgagtttatgtaactttggtactacccttttcttctctaaaataagagaatacaaattaaattacagtagtattaaacatccaagatatcaaataccaatttaatatttgaagagaacacgattctgtgaaataaagtccagctacaattgagttacgttcattactgccttcttgacatcgatcaagccactgcaaagtactgtattctggcctataaatatgccgagttatttttgtttaggaaaggtcatatacaattactaatgtcatatgtcattcacataccttcaagggggaaaaagaaaagcatcactgatacaaatcctccttgattattgatacaaaatgatggagatcgaacagagggttattatgcatctattatacaaggtactagctggggaagcaaattaagacaaacagtagtaaatatatttacagatgaagggaagtatcaacgtctgaggtatcaaaatttcttgatgttgatgctccctgtggccataaattggaggatggaggtggtttcgtgttcatggtgttgtgatgaccaccttgtttgtttgtggagttgaggccaagagaaagagagtcatggagggttggcctatgtggagccaccaaccttggttgttgttgagagttttgtgatgatgaggaggtggtctcagatgacaagagtttaagaagttgtttcccctctcttctttctttcaccttctccaactgtctaaacctttcttgaagaagagcaatggaggagttcacagtggtaggactaggatcattaccttgcctacccatttggcagtgagtaaaattttcaatcaggtgtcttctttatattttggtggggtttggcatgtagtggtttggaagtgcatgtataggagataatcatttttagctgttcatcgtttattttattcatttggctccttattgattcctgatgatagcaacagagattagaatcgactgctgttggagaacatgccaaatagataattgctaaaagttagtataggggaaagcagggtcgctggatgtgtggccaaagggactttttgaaggaggaaaagggtgagaggtagagtccaaattgatgatgctgagtagcatttggaagggagtattgtggagaataaatggttaggtaatgcaatgcttatctgggaggagatggtacttctttgtttgatcttgctggtataatacccctcctttttaataagcattaactgttgaatgcactattcttgttttggagctggagggagagtgtggtgctgtgcacaagagacaaaaggaatagagaaggaatatttttggagtttgccatcaatgattaaattagtcctaatgtagtgtccatgaaggaaagacagacaactcaatctacggtgtaagcatatgttttgtttaacgatacactctagctacttttaaattctagttatagttgtaataaatttccatatttttccttgtggattttgggttgatacaaagccataaagcttagttttgtgaaatgttaacctggcaagttgctaaattcatgtctcatttttttcatctataacctgtaactgtaacttggtagccttcatacaagtttgtgtttggaacgaatttgattgtttcttgaccaaatgctggattgttcaccattcttctaattaacattgagtctttaggaaaggaaaaatttgaatattgggttgtgaatgggttcagtggagctaacaatgtatatccatgatgggattatctttaaagatgagatattttttgcaattttaatggttgtggtcttgtggagtatcaattggttatatgcaccaagttgtggtctttgaattgatttgtgttttgttaaatgattttaaatgggttttgatttgacttgtaaacttggaagaaatgagtaggttaagtgttagaagacaagccatgcaatgattgtttctcttacaattgagtaccaattaaagaatgagtaagaatatggctagtttagttggatggtaaagttggatataaaatttcatcacatatcttaagaatacatgcttatatatgcttatatgcttaatcaattcagtgaaatattaacggttacggttagttattcgaataaacattaaattgtaagaaaataaataataaaaatgaggagtaacttttttactctttaaactagaacactaaatccgtgcaaagcatcatgtaagataagagtctcagtcacacaatataaaataataaaaataaaattagagaaaaaaaatctagagcttttataccatgtaatatactatgtaagggagaaacaaattttactattttacctaaattttcttgagtaagtttttcagtcaacaaaatgatctatatgagtgtgtttgggatagcggcacaaattaaatcatttcaataatcaattataatcataatcaatttttgtttagataagtttgttgaaaggtgattttcagataagtaattataagattaatttggtaattaagaaagaaagaggagaggaaaaaaatcgtggatttgaattctttcattaacaaaaattaacaaattactcccttcatctcaaaaagacttatatttgaagtattttcatacatatcaataaagtaagtatttcaagaaaattaatatatattatgagataattttactaaaatatcattgttttttctctaaatttcaataaatgtattattaaatttttcaaaacagtattatttattacaagacaaaattggaatagatatttgagtatctccttgaaaaatgaaagcatcaattaatttgaaatttttttaaaggctacgaagggagtaataactaacattgaccttaaaaaaagtgattttaagataattataataaaaaccgattacaaagatactccagagatacattgaactcagctaaacacaataactaggcatgttggtagaaaagtaccaatcattaaatgctctcctatttccaacaaaaaggtacagtaacgggtttttaaattgttgccgggtcgttgatcacacccaggaaatcatctttcatgcagaactgcaaaaaaaaaaaaaaaaaaaaaaaggttatgcattatatcagttaaatgagttctaaaaacattgaaactgaaaatcagataaatattcaatatccaaaggaaaaagtaatttgtatctctttatttgtcattttaaaaacatgacagtgtcacagttcatatctatagtcaatacaaccaaacggaaggataacataggctaagcatgttcaggagtatttaaactttattagcatacaaactagtatcatatgctcgctaaaacttccattaggctacaaggccatagacaagtgttcttttaagacatgttcacacatggcatacaacaataatcttggcaggaacaatacagtcaaacatgtaacatcaacaatgtggtaaacataatatcattctcattgcatgcagtaactggagaatttgtgatcacaattttctcacaacttttgtgagtcaaaacgttcaagattttagaaatgaagtaaagctgcaccatggaatagtaatcattcttgcataccacaaaagcacacggtaaatttataactccctcagggtagcaaataactttgcttggtagtaaccctaatattccatgtggataacttttgaaatggataaaatttaaatagtgataaaagagttaccaacacagtaaattactagctaacggagcataaactagcattcctcaaatttctttactattataaattcctccacaaatttcatgatatgcacaaatactagggcgaagccagtgatcatgagctaaatattaaaattagcaaaaattaaaaggctcttctgggaggaatttataatagtaaagaaatttgtggagaaacaaaagctatatttgccactgagctaaaaatgctttcctattcattcaaatttctcaaagcagaatttagcatatagctaggagttataaggttgacttgtaggtgaagggagaagggagaggtggtgggttcaaatccctcccactaacattctaacaaaactaacaactaacatttgcctatataaaaaaatagaagaagcataaattaagctaatggagcttaacaacattcaacaaaatgaagagacataatatatatagaagtacaatttcagtagcatccactggagtcccgattatctttagtctcacttcagtatctttttgaatcttaacttgcaaaagaccaattgattagtagtaaaaattatcataaaataaaaaaaaaaaaaacaagacaaaaaaaaaaaaacaatttgctctcttcttttccattgaggaagttataattgagatatactgatccatctgaagtagtgtaatttggcatgtctccagactggaactccatatcacccggaatcaactaagtggggcaaaaagggtcataacaaacaaaaatatatataaaggtaaaagtacaactacaagttgaaaattttccattgcaaagtaatggcatattctatcttaaattaatttaaaaaaaaaaggaacagaaaataatcctcggtaattctaaacattaccaatacaaggaataattggctgacaatgatcatcttttaaaaaacaaacaatacaaggaatttttcctgtgtttatgaaaactggaatcatgcaccgcctttttctatttggccaatctcaaatttgcacaatcatctctattctggccccaaaactgttacattaaatagttacagaagtccattacataattaagtttcgagctgaataattcatttcatggtcaagatcttcacgctaataaaagtcatttatcttggaaaagaaatcagataggcataaccttaacccatgctgtatgggtacaaatacaggtatatgataaggatacatcccatataacaatacataataataaataaatatatatatttaaatgaatttatctacatgtggtcatcctatcctagcccaaaatcctgtcattcccactctcccaagcccctatgtgataatttggaggaatggaggctcccaagcccaaaataatcatgtaacccaaaacctcatttataatattttgacagagtaaaaaacttgcattgcattccaatagcaacaataataaataacaaacataatattggctttcaaaattgaaaacttgcctagcattccaatgacaggaacaataaaggaaaaaaaattaatattcaaaatgaagaacaatagtaacaatcttttagatatataacatggagataatagagaccacttctcaaatattacaaaagacaaaaacttacgtggtttgaaacaatgatttggacaggtccagcttcagcaaaaaatcccatctacacaaaaagaactcaacagtcataaaccaaaatctccagaagttagagttacacagattgattactctaaagagaaaggaactgtataaaccttgttcaccatggtaacaacagcttctatgttttctatcacgaattaagcctggaaatggtctgaagacaacacattggtacttaattggaaatgtcacaaaccctgttccatcacaaattaagccttttcctattttttctatccctgtaaccgccaccacaaatccatgtctaccactgcataataattgaaaatccaaatgttacatccatctaaggtccaaatcagtcacttaaggataaatacttttctctgatctaaattatgtacggtccaaacaaatgcacaagaaaaattactcttattaacatgtattactgggtagtgggtaaaaatcaaaggctcatgccagagggcaaggatgagatgaagggttcttaactcagagggaattgagtccttgttacttgaggttggggtattgtgattattttggtgttactttattgcaattgcagatgtttctatcttgaggtggcctttcaagtgtacttttatttcatgcttcattgtttctttaagtttaacaagagagagaaacccaagacaaagttagcacttattcattgggtaactgtctgctaactttcacaacttcaagcatcttgaaaagcttatcattgtcaaaggactcaagttaagttcagggagtgtataagagaaatagtatggttaactgattaactcgcatatttcatcttctttcccattttagcacaactcattttctagtgggaaaaaaaaatattgaaaggatcttaaggggaatcacctgcaagtgccttccacatctttcattagtttggaaataagattatcacgaaggttacaaccaaagtagcgtggatgcagctgcatctttcgctccagcactatgtggaaaaacattttcgtgtttcttcttgtcgctcccttcttgcccaatctggaaagctagttacttactactggccaaaaaacacagaataagaatagatttggaaaatacaattaaaaaagctcaaatgcatgtattagaatgggaagtaatgcatcactaatttttattacaaaaagtaatattaccacatacaattacgcagaacccactagggtcggcctagtggtaagggattggaatagtgtgcatgagatcataggtttgaatatcagtgccatcattatagacacacaacaacaaaaatatacaattacgcatataaaactgacaaatggaaaatccaatgaaagttatgttcaatattcctgattgcactgcgaaacaaagattgttacactaaatgccagcaacagaacactgaacaaaaaaaaaaaaaaaaaaaaaagccttttaagactctgctcaagcaaacaagcactctggatccaaaatgaaggacaaaaaaatttcaagctttggcacacaaacaagaataaccggaagagaatgcacatttgtgatgatgagcagttacagtgaacaagaagcagaatccagaagagaagccataataattttcaaaggaatgagatgtttagctatgttcacactctcacgtccacgcagaaaagtgaaaacggtaaacttcaatttgagtcacccttcccgaacctcgagtataatccctaaatcccacacaaattgtaacttattaatttattcaattattaattatatttatatttaacagaaatttaatttattactaaattaacattctttttttgtaaaattaaaacaatcaacattgaataaataatccttactgattatttttcttttttatttagcatgataacagaagggtatttaaattagattactacaatagataattcactagggtcaacttataatgaaagggtcattaagtttaagtagtttgcaagacagtttaggttcaaactttatttttgtgtacaccaaaacatatcgctgcaacccagaacttttaatttgttgctttacattctcattggttccgataaaaaaaaaattaaaaaaagaaggttagtattgagaaagaaattggtgtaaaaaaataagtaattcatgatttgatttcacaaaaaatgggagattaaaaaaatctaaaatcgtatactatttgcattctttccaaatgagtaaaaagaaagtggtaagcaagagtatgttgttttcttgttttcaaatcatagcttttgcattactcccttccccttcatcacttctttgttttttaattttctcatgactgactacattattgacgcatttagatggatacattgaatgcccgcctgctctttctcttgttctgggctttggatgttgttggtaatggaagatggattcattcgtttatggttttaatcatggttttgaattggatggtgtacaaggcacgtacatcactaatagatagattccttgaacatggtttcaatgtttgaactaattaacatatagggaaaggtggttcctgttatgggaagatagaaaacaatatgtaaaaacacaaaccaatcaatattctgaattccaaacgtaagagttgatattttctggggacccaaatttctaatatataaaaatataatggttctcatacagattcttctgctacacaggtgtagttacattagtgaaaatggagttaaacacaagggaactgcaaaagggagcagaagattgcatggaatgttggcatcctcattgtccagggacaaagttagtggcataagcccaagcattgttggcaacaggatcagcaacgtggtcgtaaaggttctgaatagggcccttgccagtgacaatagcctgaacaaagaaaccaaacatggagaacatagccaagcgaccgttcttgagttccttgaccttcaactcagcgaatgcatcagggtcatcagccagaccaagagggtcaaatgcaccaccagggtagatagggtctagtccttcaccaagtggtcctccaccaactctgtaaccttcaacaaaccccatgagcacaacctgaacagcccagattgcaaggatgctctgagcatggataaggtttgggttgcccaagtagtcaagtcctccctctgagaagatctgtgaaccggccttgaaccacacggcctcgccgaatttgacaccattcttctcaaggatctctgggaaggtgcagccaagggcaccaagcattgcccatctgctgtgaatcacctccagctcccggttcctggcgaaggtttccgggtcagctgataatccagcagtgtcccatccgtagtcaccagggaattctcctgtcaggtatgatggaatctgctctgagaatggacccaagtacttgggacggtcagggccatacctgttttgtttttcacaacacctcatccaaagtcagttacattctcagacaaattgataaaacctagcttcatatgtgttagttagctgatgttttttttttttttttttttttatctttataagacaagacaataactattattaatctgttatgcttacataatcactggctttctagttagccccatcctgctgagaattgttaagtacaaaacatagatatagttctatagatgcttttttggagttttacctcattgataatcttaacatataatgcgaacttttgttacatgaattagtgagttaaaactccagttttaattccctccatttcaaattaatagtcgtctaaagattcttttagatataccaggataaaataataaatagataaaaattaaaatgacaattattatagaataattttttttctcgtacactataattataatgggacggaagaagtagaacagaataccaaaaacaaaaggtattgcatctaagttttgcggaattactagtattaatttatgttgtcaagcgagtattatattaaaacatgtaatactaagttgaactagtggagtgggaagggtaatgttgagttaccaaatgctctgaggagcactcttgacggtgcggcgcatgttagtgcgacctttgccggcgccaccggtcttgcggacgaactcattgacctgcttgagagcagtttgaccagcgaatgctgattgctgaatagcagaggtggccatgatggttgtgttggctaaggctttttttctttggttttgttttgtgttgtggagaatgaagaaggctactacaaaggtttatagaagatcgtatgatattgtggatcaggatatgcacaactcagcaacacctcattggtcgtggatttggatgtggattctcatgctgatatttcgacatgctatagtggctcttcttctgccacgtggatgcaaagatctccttcctcagatgttttcgagagggtcgatgtaagccacagaattcaggtccaacaaagtcaagaaatttaaattaaaacttggaaattggtatggaagatagtttggattgggctgatgctacagtaacagtgcaaacccgtgagtgactcattacattttttttcttctttctttttttatttttgaaaaaatgaaaaaatttgtgttgctagtaaaaccacacagaaacacagggctagtagtgcctcgacctcaagaacacaatgtggcagctcatcttcgctacattacaaatttggtttcatgtggaaattatatcttaggattttagaagagataatgacctctttaatttggtgtcaaaatcggtctcttcaagcaaacagtttaaaaaattagtatgaaaaatcacgaatgaataaactgtacatggttaaaaagtcgttgaaaatagaaaaaccacatttgaaatacaaaatttataactattaacttttaaaaattatatctaaaatgtgaaaaaacccatctaaaatgtgaaaccaaacatactactagaagttttagattaaatttcaggacggtattggttttttaattaaccctcaatatcataatcaagaaaatttgtatttaaatgagaattacggtaattaagaaaaaacaaaataaagcagcttaactgaggttaatgttctatttaaatattcaatcacaaaaaattaagaaaaataaatatggtttaaatgaacaactgacataattaatagaaaaaattgatcataaaatattttattcatttttaaaaaaaaatatatatgtatatatatatatatatatatatattacttatatacaatatttcttaattatattactattataaattaaaaaatagaaagatattgaattttagattaaggcctcgattttataataatttcattaatcttatttattgtcacatacatgacaatttcctaaacataaagtgtcttgttgttatagattcaattttattatataaattctacacgtggtaacatgtccactatcgcattttataatatgtaactatttataattttaagttatcttttaaatagttaatatgtcgtcatgtatagcattgaccacgacaagagttcatatataaaaacacagttctttaatagatgatatttttcacagaaagtgtgaatgaagtttcattgaaacattttcaaagctcaaaatataaataatttatccactaatgatcaaacttcaaagctaaaggagtgcagttcatacttataaaaatcaacatcatcccgaacaccatctgaaaacacacttgcctgcatcatatataaaagtaattaattagcatatctgaaaggagttctgcaattactttttttttaccatatatggaatcatgaaaaacgaagctaataggtaacttcggcttacttgaaagctttcgggggatgtaagtttatttgaatttgtactctaaggcttcactttagccaagaaagtctaaactaatttagtttatcttttcattttctttatcttcatttgctatttaatttaatcttttgcctttaaaaaaaataactttttttttgttctaatcttttatcttttttcgttgtttctaaagtaagcttttatctatttcattctcgttgggtatatatatttttaaattttctctgatatttaacatgcatatgaaatttgcttaattggtttctttatttttaaattttcacttatattaaacatgcatatatagtttctactttttccatcttcggagacatgcaaaaaagttttaaagagagtatataaaagaagaaaaataagtccaactgagctacaaaattcatacggctaagctaaatgattcactttctacgttattattatcacaagactttttataaagcaaacttgacaagtgatgcaaaggatgggaattgagttatggagacattgacagaaacaagttctactgaaaatatatacaataatagattagaaacgctaacgttcacattaattctctgtagggaagtgatggggaatcaatgaagcttatctacattcggtagtacaagcaaatgattattctacaatgactacaaagaaaggaactgccacaaatgaatacatacattaacattacatatgcagcaacattatttatacactgactaaagtcgttgggcgtgtcaagttgatctgcctgctctaacgaattgtcatgttcatgcctatttgactaaaaattagtcctacagggaacagaatgaacatcagaattggaaatactggagaaagatagaacgaaggtgaagtaattgattctgaagcaatgttggtgctgggattgagaataactggaagaatattcttcaaggtccattcaaatacgcatgcaagagcaccaatcaagacgcagataccccatctcgtagcattcagctgcatgcaatctgctaggcctttagcatactcaatcaccagcacttgcataagaaaacaaccaactaaggccaccaagaaatagaagctctgaacaaccatcttcagaacctggttgttgagaaaattgcagagttggcaaaataggaatgtgttgaagatcatggtttccctaacctttttatccttgccagtaacatgtccaccgaactcaagtatcattgacacagaagtctgatataaaacctgaataacaatgtttttccagatttctttggttataatatgttggttcctataatcagatggttgtttagcaatccgttcctcgccggttagcctcaataccatcattaggccacccagaatgcacatcaagacattcacccaaatcaactgggatgctgcaaggggggaatctccagtacatgttgtaatcaaggttatgactgaccctgatatggtacatgtcagctgaagttgaatgaacttctgaatattgtggtattgacttctgccagccatcacaattggttccaatacactgaaaaatttgattgttatgtcacaactatctatatccactattgttctcagaggatcaagaactatccccacatcagctacctttagaactgaagtatgattagtcatcaaccttgttccaatgaatgcaaccaccttacctttctcttgcaagcactgtatcatgagaagtttgtctttaggatggaagcttcccattacatgggctcgatccactttgtctaatctagcttccccattcaaatcccgaagctcttttccttcaagcacattatcatgttctagtcctagtccacaagctatgcctttcacttccatgatgccatcctccgagaccagtttgatctgtatatttgcatcattttttttcagattttccaaagctgattttatggattctagactagtagtgcatttgagacctatcagtcctaacaagatcagttcttctttctcaagttcttctccatctgtttgtctataagcaaaagcaattggctcaaggccaccatcctccatctcttcaatcacctgcccaaatttgatcttttggttttccatggcatggcattcccctatactatcatagtacagtgaacacatatccaatattgtggatgcagctccactccagtgcatgtacagaacttgttcattgtccccaatttttcttaccaaaactccgctaccttctttgccagaattcagattgctgtgcttaagaatgtcaaatttctcttctgtgaaagatctcaagttcacttccaatgttgtttttgcccaagaaacaagtgaattagacaaagaggaaagagaaatctctggtgcaaggactgataaaccaactccttgtttaagcatgtcaagcgcagttttatctatttccgatccctcaaccatgctgacatctttctcccccatccatactctgctaacctccattggtttagatatgagctcacctgatacatcaatgcagatgacagttaccaaccccattgtcgtactagctgataaatcatttagaacagcatcttggtttggaactaccttatccatctggtacttgagagaaattgtaaccacaagtggcattccatgctgcacgcatagtattgcaacagtgacaaggcgtgttaaagtggaaaccgttccttggggtctcaagaaagctctctgaagtgccttcatcaacaagccaattgagaccttccccttcatttctggcaacccactattgttcccatcttttccacatattaggcgaacgaagaccacaagtaaaaccagtagagagataaaaagagcagctatgtcaacgtaagaaattggcttctcgattagttgctcaaacaagcccctcctttcagccaaattggtgttggttccaactgatgttaccaccatccttccctggcccccaatcacctttgaaccagatataagaaacgggttccccttaggatcatgtttgctttttgttgcctcaggctcagccagcataaggatgccatcacttacaagcaaaccgtctgctggaacctcatcacctggccacaggcatactctgtcaccaaccacaatattagatatgggaaccattacgatctcttcacctctcttaaccctgaattgcaactcgacctttgtctttgccaatttcaacattttcctctcacgccaaaagtttgctactgaatttactacaaccagtagtaaagcagcaaaaactatagcaacaccatcatgccaaccatgtttgggtccctcctgcttgaatcctatggcgaatgacaacccagcggagacgaacagcaccaaaattgtgcagcggtagaacttgcagctgttgaaaaaaaatttggacaagtttgttccaagaactggtaatggtatagtggtcttgccctgttcataaaaacaaaatcccatcaacaaaacacatctatctcaacccaccacaaacaacagttagtagatccatccttcttcacacttcaataaaccgagaaatttgatggtttaaactagaagggatcctccaaatatcataaccaccatgtggatgaaaaaacaaaagaatcactccctctttaatgtttttccatgtagtataggagtttagcaagaagttgttggtccgaatggaactgagctcagattccttaaacaagatctcgaattcgagttttgtggatgaaaaaacataattgagagaagatatctcactaaaagtgatcagtcaggttcttttgtagaaattaatcatcagctaagttggtgaatcacacctataacatgataacccaagtttcattatttttctttgtttttattgttgaagaaaagggcatgaatatgaggaggggagaaggttgatatatacctttgagtattgatgttgacgaccaaggacagcggaaacggagtcaacgccaccaagctcattgagggatttcaagtccttctcctttacaattcgagcaatatcactcctaatgtgctcttctctttcttcttcttcttctatatcaattgcaactgaagatttggaagaggaggttctagcaggaggtactgaagtgtacggtactgaagaaagtagtgatcgtggcgactcatgtttgtcggtagaagttgttgacttcttgactgagatgaggaatcttatgtataaacttctacgccatattctggtgtacttgctgttgccggtggtggtgaggagtaaggtagcaccaagttcaatgttggcaccaccatcaccaccaccagctgaggacgaggttgcttgggacatgtcttaaatatgtcacagttaatgagattggtttattgataaaaagaaaaggaagaaaaagaaaggtgacacttaattcgttatttggacacaatggttgattggactgtaattcaaccggaacaaagcctacgtttcttgttctcaagatccaactagagggttttcagacactcatatcatcttgcaattacacacacaaacacacacgtggtttaaacaaggaattatgttacacatgatggggttatgttacaacacggaacaagtgtcaaagacagacactatagagaaaggttagtgattgctcaaattagattttgatgatttcaagccaacaaagaatggtcaatttatagcgtccaacttggatcacgtagcaaatataataaaactcaagggtatcgctgctattaaatgagtttttatcatggatcaatgggaatctgccacgattccaaggcataaacgcgtacgtagcagggtggagaaaaagtggtttgcccttgcccttgcccattatacgcaaatttttatgttcaatcttttatcggccacatgccggcaacccccacccatttggaaattataaggcaatttactattaccaaatttcttcttcacacgtcatttgcatggtttctagaattctttcacgatacattgcacgcccaaaatagaataaacaatatttcttttttcattatgacgttggtgttgtgaatttttttttttctgattacctttttttttcatttataagaataaaattttactttaaaaacgaaatctaatttcactcaaatcaataagttgttagtaaaataaataatatatacatcaatggtgtgtaaaattttttcggattgttatttaatcacaaaatattatcttcacaaaaaaaatcacaaagtagtattatatataataaatttgttgaatttttatgataattatttttaaaatcatattaaagatgatttataattaattgatagtgttcaaatttatacacaacaaatgttttaaggaaattattttaggttttattttgtcggaaattaaacatgcgtggaatttcaaagttaaggatatattaaattatataggactccatgtcatggaattaatttttttcttaaatatgcctaagaaaaaactacaaactgttaaattaaaaaaaaaaagccctaggaatttgatttactaaattgatattttgaaccgtaaatgaaaaggaaaatgaataatggttttggtttttgaaaatttaatacaccatttctaatttatcattacatatttattagggtataaataagtgcggttcactcataaatttaaattgacccaaatcaatccaaagaatttgggttgaataatttttgtatttaaatcagactcaatatcaaactagtcaaattttggattggatcaagaattttaatatttaaactcgttgacatgttaattgattgatttgagttgatttttttttttaaaaaaatcaatcaatatcaagtcatttaaatttgatttgatcgctttacatcatttgaaatttttttctttaacctactaaattttcgtttgtgatttaaatccgtaaataacttcttgactaaacctttgatgccagcttcaacatgtcattagcatcatgtcaggtattattaagaatacctcctcgttctaccattttacatataaaaaaatgataaaattttatgaacgtagtacttgtccaatcggcatttaaaaaattatatataataataataacaacaataacaatatgggaagaaaaaaaaaagacataaaatttattataatataaaatatatgaggtcatcatcatgtagtaacaaagattttcactattaaattctaacacgtatgtgagcgtagattgttttcttatatttagtactttagttttcagttaatttaatattctagataatgatttatgtaataagtcaaatctgcaatggaaaaaagcatgctggcctctatacgttttggactattcgatctcatttctcagccttctctcaatctaagataaatacaaaatttattaaaaattacaaaattaatagtgaaattcattgaatataaagggaaacctacaaatttttatgattttcaatgctaatctttctcccaatcccgaatgagaaggtagattgaaagttctttacttttctttttttattatgtatgctttttggaacagtaatgacataccaacattatattattttaaatattttattaatatttatattttgtttatttctttttatcatatctcctattaattatatatatatatatatattaaatgtcttcaaatgtcaaatagattcgtgctattcacatttttgtttgttaaaaaatcatttttgttttgggaatagggagccgtttcttatgcattatgaattagggcatgtttgcattaacttctccaaaagtatttattagagatgcaatgaaagaaaaaaaaaaaaaaaaaaaaagcttttccatgacattgtgaataggtccacccctaaattttaatttcatgagataattaaaatttattttataaatttaattattattaaatttatgtcaaatgtatttaatttgtgttttcctatttcttttcttgtgattttgttctttctattttaaaaaatccataattttgttcacttcttaattttatatagatttttttacactttaattaattggattttttttatgatatcttaaataaatatgttaaatcttggactcaaatagatcaaaataaaagaaataacacatgcaaaattaagaattgaaccaaaatcatatattttctaaaatagaaaaacaaaaaaaaaaaaaagaaccaaaattgtaaatcaataattaaagtggaaccaagattacaatttaatctaataacaacaataaagatggataaaaagaagtagagattatatacatatatgagattatcaagtaacacgtttgttgcttccttatctttactaatttagttttagtttatttaatattctagataatgatctatgaaataagtcaaatctggaatggacatcaaaagcttgctattcttctaaaaaaataatcaaaagcttgcaatagtgctggcctatacgcgtttggactattctccgttacgtctcaatccaagttaagtgtcagttctagcttacacactctaataaataattgctatatgatcgaagtgcttggcattgctttcttttgaaacatcctttaaattgctgcattctccaattctcatctaacttcatttctcttggaattttgcttgaagaaataagagttttgttttcttggcaacatgttatgggatgataattgcacttatggagtcaaataagtacgttttaagaataaatgtttaaattatatcgatctcataagtattattatacaaaatctcatcaatcaaatcgtttttttctaaaaaatatgagacatctaagtcatccaaataaaacaatctatttcttgataagaaaaataaaaaaaaaaaatgtgaatggtgattgaattgatgataaaatagaattttgtgaagttcctggttatcctaaatggcaactgactggattctatggttatcatgaacgtgatagaagataagactcatggaatcttctatgtgctattgcacatacttgagtgattggtgcatttttggagatttcaatgatctactttcaaatgaaaaatatggtatcaataatcatcaaaattgactttttagaggattcaaagagattatcattgattacaatctccatgacctttctatagaaggttatacctatacatgggctagaagaagaggaaagcatgatactattgaagaaaagttggacatagcacttgcaactgggcaatggattgataatttccccaattttaggctgctcaacacaatatcctcaaagtctggtcattctccaatcctactgaggcttcatggcaaaaattctaacatttttggagaagatttagatttgaaaatcaatggtcgatggacccaaattttcaatatttggttgaaaatagttggacaatctctttgtccaatgattttcttactaaattgaaggcatgcatagaagatacgaataatagggggaagcaattgcgcctaaaatatcgtgctcaaattgataaatcaccaggaacatatggccttaagccaacattcttcaaaagattttggcatctccttggacctaaagtgcataaagttgcctattcttggttataacaaggtacattccctccacaaccattcttttcatcccaaaatgtccaaaccctaccaccatgaaatattctagaccaatcaccctttgcaatgtcctttacaaaataatttcaaaaatcttagccaataaactgaacccaatccttccaaaatgcatctctcttgaacaagctgcttttgtataaaacaaatttataattgacaatgtcctgctagccttagaaattatccaccacatgaaatgtaagactcaaggaaaagtggggacgtagctttgaaaattgacattagcaaaatgggatttcatgaaaaatggattggttggatgaatctttgtctcacaactgtgcaatattcaatcttggtaaatgagaatcctattggaccaataactattgggagaggactaagacaggtgactctctatcgccctatctcttcatactttgtactgagagtctttctagtctaattaaaaaatatgagagaacaggagatattgatggtgttaaggtgtgcaaggtgctcctaccttttcacaccttttatttgcttatgattgttttctgttttgcaagactcaagaaaatgagattaatactttgaaacatatcttggacacttatggagaagacttagggcaattaatcaatttccataaatcaggagttctctttagctcaaacaccttagataaatgcaagcaacaaatcttagtcacttgggtacaacaaagtttaggagctgaaaaatacctgggtctaccatcaattgtgggacggaggaagaaagaagtatttggttttctaaaggaaaaaatgtggaaaaggatcaatcactggacaagcaagaaattgtcaaagacgagtaaggaaattctaatcaaatcttgtgcacaagcaattttatcttactgcatgagtgtatttcttcttccctcttcactagaagatgaattgcaaaaaatgatgaactagttttggtggggtaccaaaaacaatatgcagaggagtatcaattggatgagttgggacatattaacgattaaaaaagaaaatgggggaatgggtttcagaagtctccatgctttcaatttatctatgctaagaaagcaagtttggaaatttatttcattccaagatgttattgttacaaaagttttcaaagccaaatactttcaagattgtttttctggatgccaaacttgagcataatcctagttttgtctggcgtggtatctttgcttcacagagtgagataaaagagggtatcaaatggagaattggaaatggaaactaaatggctatttggaaactaccatggcttcgaagaaatgactacccatatgtttctacggctcaaccccaaggattagaagatatgcatgttggttctctaatagatcatcaaagatgttcatggcaagaagacttcatggtggaagtcttcaatgaagttgacttgtaggaaattagaagcataccacttcttcacgtgctagaggaagacctgcgagtttggaaattcatgccacatgaagaatattttgtttgcactgcatacaccatgccatatggagctttggagaatgaaagttcctcctaaatttaagcatttaatctggagaattctgaggaattgcctcccttcacaaagtagattgagagataaaagagttctttgtccactcacatgtgaattttgtgaaaacaacattgagtcaagtcggcatatcttctttggatgtgattcagcaattgcaacttggcaagaagcaaaactttggcccattattcagagcaaagttttgtctgtagaaggtattgtccctctcatttttgacatcatcaactttctacatgaaaaggacccatgcaaaaaatttgctactgcactatggcgtatttggaagcaacgaaatgataaaatttggaggaatcaggtccagccaacatagatcacgattcaacaagcatttcaacaacttgaagaatggaagcatgcaagacagcagcaatcccagtcacatgtaatgcagattttaaacaatcaatgtgagtggaagaaaccatcttttggatacttgaagtgtaacattgatgcaacaattttcaatcaagatcaacagtttgggaatggaatgtgttttagagatcacaatgggcaatttattcaagcaaaaacaacatggtttcaaggtgttccagacccaatagtagttgaagcattcggctcataccaagccagggaatggttaaaggagagcaacaacaacaataatttttgtgttggacaacaggcttgtggttgatggtttcaacaataacaacaaaggtttatcatatttagcttcaattctcagtaagtgacagttctaattacagatcgtttgatgacaggtggaaggcgtcactccaacaatggaagataagccaaaggaagatgccacaagggtgatgggcaacccctaatgagtctaaacgggttcagcatgaaacctaaataacattctcataatacataattaattgtctggaaattcaagtttgtccattctattgcaattttgtgtacatacaggcaatcaacctttaattattctaaatgcgcaccattaacgtcaattatgaaggctttaatttctagtggtgcacatgaaaagacatcaaggctatcaactactaaaataaataaaaaaacgaaaaataaaagaagtataactttatttaattctaaaaaaagagtcaacaacaccctccatctcatgagtctttaataataatcatgcactgaaataattttgattcaatgttcttcaacgcatgtacaacttcaagaattattgttaccacttgttgtaggatctcctctgcctttctggctctgatcatacgttcttctagtccttctgttggtccttgaacttaattgtcctcatcattaattgtagggatctttttaatttctttaacaactcattagggagttttgtaaagaggccaacaattttgtggctcattgtcttgcaagaacatctaatttgtatgctagctcttatgtcttctaccaaactccattatgaatgaaataatatacgtctgttcctctataaaaattactataagaggggtacaaattgtttatgcacgaactaggtgcatttattaaaattaaaaaaaaaataaaactaggtcatttcattgttgtctaagaatagaagatttataaataatccatcatttagatgacaagttattacttatttccaattttgaaatagacacctgcacattttgaaatactcgttttcattttcagttaatatgttttcattgtaatgataaaacaccatcctatttcatattctcttaacaaaactttatcaacgtctatttgcagactaaacattagtttttttttttatgttttttgtttacaggattagtatttgatgttatttatactgacatggtgtaattaattgcgatttcaatatcaacaatgttatttgcaaggcattttaattgcgccattctgacacgcttttgttttgtattttttatatatataaaaaatattaatcacaacctttttcttttaccaaacagggtttccggaatggtgtgctaaaatcgtatacaggaagcatctcttttaatatttgcggatttgtacttgctgcatatcttctatccaacaccatttaccaatatcatccaggattacgttgtgattgtgaatgcaatgcatggaagagaggagcgaacaaaaacaactgcatatgccacatgtcatgtactaaacctacaccaacttggattacggttaaggaatgatccttggccaagttattccattggggaaggccctgcttcaattctgatgtcaccacaatgctcgctaccaagcatgattgccattagcataagtttgcctgcaactggaaaatccttgtgttgcatcaagattgtttcgactgaactacccatatcccccaaaatagaagtctccatgttttcttgtctcaaggacaaaacttggtcaaacccttcttcaaatgtttcgctttgaggtccataacacctacttgaagcctggaaaagtatagtatttttcaagttttgcaggatttcctggtcactccaaccttcagttctgtacgaatcatggaatttactccaatcgtcctgactagcagctttcttccaacaatcctccaaaagttttctgtggatcttccgaaatgaggaactagtccatgcaaacacatcaaaggccgacaatgagagttctcgatcttcaccttccaggcacaatttaatcaagtcttctggatgaagcagctgagcttcaacaagttgtctatcttcaatggaaggatgacgtttcattaattcctcctgcaggtaaagcatctaaataagaaagggtaaagaggactcctaaaagggtgcaacaaagcttatttgccagcgcaaggttaaacaagttctcatgaaacaaagcaaatattaaactattaattttattgtcatacagtcacataacactcaatgccacaagtcagtcaatttgattgtcaaacgtgtattctttacaatttaatagcatgccaaatccttcagcaggctccttattttccctccctccaaaactaaaactttttataattcctcttcaatttcatgaataatttaacttcctacaacaactgtcacatcaaacccctcaatcatgtatttaacaacttattttaaagaagaaatttaaacatagttataatattatataaagtataaacttatcatgcaattatatttgtctcatgttattgaaagttatttgtgatcgcaaaatctacccagttcaaagagaagtttttatcttgctacaatataattaactattaattatactttataatgttggtctttacaacgttgttaaaaagcggtcatggcagcaccatggtagattacaggttagatttctgacaggccaccattctatggcagtggcatggtgggtttttgtggcaggctatggtggccgccatggttcagccatatgccacaacaccatcaaccatatttttttggcagatttttagctggtcaatagaagccaccattgataacactgcgtcttaaaaggggtaagatcataagagaaaaaggtgggagtaaccaaaatgagttcaagatagattagtgactatacaggaaaggacaggatatggaatgagtgtagatgaaaagatattggtgtgatacctatcaaggaaaagaacacagaaaattggttaaagtaatttggacacttgcaaagaaagtcactagaaacacttagaggaaattcaagaaggacaatggaggaaattaccaaaaaggatctcatcataaatagaaccctagagaatttggtttctaatcaagcagaatagcatcatgtgagatgtgatctatagttgacctcacctagtgagataaaatttgttgtcgttgttgtatttatatcattatatgactagaaattaaaaaagcttatatacaaatttagtccctgtaagttcgaacttttttcaattttgtccttgtaagtttttttttttttttttttttcctttttagttccttaagattgcacttttcaattttggttcatgtaagtttttttgttcatttttagtctttgtaagtttgtgctttccaattttattcccttagagcacaaatttaaaaggactaaaaacagaatcttaaagggactaaaattggaaaagtgcaaattgacagggactaaaaatgaaaaaaaaaaattacatggaccaaaattaaaaagatgcgaacggactaagttcatatataagccaaataaaaattcaagtatttttagtaacaacagcatctgtttgctcctaacatatcaagttagctttcaaacactggctgatgtcctagagtttcacggatgcctaatactcacgatgaatgattgagaaaataaatcaactccctcttcaaattatcaattgttcaaaaataaaaactcaaatttacctgtaattttagaatcttcaaatcagcctcaatgcggtccaccttgacttgagtaccagcatctttaccagctgttgaacaaaaaaacgtaatactttttatttattgcaaatgaaatttattaggtatctattcattcaaagaaaaattagatatttaactaactaaacctgtgtccagttgaaacagtacatatagataaaaaagagagagagagagagaaagaaatcagaatataaacaccaatctttatccaatgacttgaataccacaaccaaatgtggacaagatataatgcttggtcacatgtaaatatggaaataaatcatgagataataatgaaaaatgggaagtaatcctaagatactccaaactattcaaagatatattcaagatattattagagatttttaatatattctaacacagattaaagatttctaagaatctagatattcaccaattcgcaacaataagtaaaaaggcgacattaggttgagttggtaactgacatatcatataaccaagaatccagcatattatcagagatagcagaaaacttaaagtagattgccggccattgagttcaaatactccctagttagaaggaggaagacatctaaagaaatattaaatagaatgaagagaaaggaagtagtctccataacacatggaaaaacacatggtgccatacctgcaaaggcagcaatcttagagagaaataaaagattttttctgtcagtcaattttagtttcattttcatatactcctgttctccttcctcttcagcaactgaagtagattgcatgttttgtgagagagccaatgcatgaagtgtttctgaagcagaggaaaattgatgaaggaacaaatcatgaagccaaagaagatcgggatgctcccttaggaaaatggatagctcttctggaaattcttcccctagccttaaaagttgagaaaattgtcttctttcatggagtttcttaaagacatagtaactaaatcccccattaggtcccaggctttcatgctgcacacaaacaattgagacataagcaagaatacatttaaaaaaaaaaatggcaacacatagtacatatagaatccttgtgattaaataataccaaatagaaatcataaattatcattttccgataaccaattttgtgtgaaaggccgaggttttattcaacattgggaggtgtcagcgatgtaattgtaaataacttatttatactattactagtactaactcatttcaggtgccgtgtccaaaataagacacttttatgggtatgtcttgtgctctgaaagttcataaaaataattggtgttgcattgtgcttgtgtgatggtgaagaacatggtcaaaaaaaattcgtatacctggttaacatttgtttgcacaatctttctttggaagctctttccaataatatataaaggcttaaattgaaagaaagaatatgtggagctatacaaatttggtagtactgtgaggtttgttgttggttcttaattaatagatctttattcatttaaggggcattttgtgtcctagctctagctctaggtccggatgtaactgctactattgcttccttatggacttaagttttaggagtgcaattattttttctcagcagacttctactcaatcctaaagccttatcagtaacggaatatttgggttgataagctaagaaaatcatcattgcaatttgcaaatgcctagaaaaaagggaataaaagaaacatcagtgcacaatgaagaataaaatcatagtcataccataatatttctcagtaattccgagtcattcacatcacaacaaattgtccacataactttgtagcatccatgtcgtttagcaattgataacagatgtgaagtaaccttcattatgtcctcttcattctgctctccagctccttcaatcaaatcctgcacaaaagaccaattgaacaatgtatatctatcccacaccaggattgcaaggatacggtaagcaagatagaataataaccttgtgagtatcttcaaattctttaactttttggtagagagattcaagaaggctatctcgcctctcccaatattcatttaacagacctttgtgttcttctccgcactcatttttagctgtaacagcaccagaatatgcctcaagtagaacttcagctagggcttctaaatgattatacagatctaattttgctgttttatcaagtccagatatttcatttaacaagtgaagcaggacagaagcaacactccaaataccagtccgtacaacaggttgacaataccaaggtgttaaaccttcaggtggtggataccataatcggttctcattcttatagttgaagcatgtcctaattatggtaacacatgcagtagagagttcacatgccctctggatctggattcctaacagatgctctggtcttataacatattctaactctgcatctaagcagtaaaagagatcttcaagatctgaaaccttactgtagaacacttcagcattatctctatccatcaaaaggacagtattccgacgagctctctcaccaactaattgtataatgtcccaaagggcacctgacatctgaatattcaaactagaatttgaggagtcaacattagttgatcgattttggctaatcagattttgcagttccctcagctgaatcattgcagataacttttcaccatgctccaaaataatttgtaaggcatgtcctgggaattgaaaaaaacatcatttagtaatggaatgtccatttgctgttccctaagtgttgttttaacttgcatttttacctgaaactataattatttatttcacaaccttaatctatttaatcaattaaaaaaattggctgggaaaacatgaccattaacaaaatcataaatcaaacatgccttcacttataatcccaccctaacaagtcaaatgacatcaagaattaagaatccatgtgctttaggatttcattcactccttccttacctaattaagcttacattatttttaaaactctatgtgaggctatggggaagaaataagataattaagcctcaattcatttagttgcagaataaacctccttcctttgattttttcatacatgctgaggcaaaggagcagatggatgataattgagattatattcatattcattttacccaatttataaaagtcaataagctatcagtgaaaaaccactctccatttttgcttgtgatatactttgtatgagatcatcctaaaaagtatgattatatctgattcattttattttataaaaacaggctggtagataaataaagctcatacagacatcacatacccaaataatgtaaaaactaatgaccaagttaaacataatcaaacaagtgagttgcatatggaagtattgtaaaagaaattgtttgaagatcaaatcaaaacaaataatcttttggtgaatagactaaaaatttcatactctgcttagaacatagctcctcgtggcatttggataaggcaagaaagtgaaggaacttttgatgtttctgctgcttttctaagagttgggttgaaacaacagccatggccaaaatctctgctcctctggttgttgtccaatgtttagctaaggtgtctatgattgatttgctcatccgaacaaaaacattggtttccccatccctttcaaatgaaccagatgtttcaagcttttcaagagacctatcaatttggccagatgataaaaaatcattgaatagattattcaataaagcttctgattcttcatctagagcagttcgacgtgcaatcccactcaaaaccgtcctctgtttgtctccagcactccatgcttcagagctagcccttctaggagcaaaattacctgcaaatgtaagatttcttatatctttttgtgcagatctttcatttgaactgcctttacgagataagcttctctcaggtggttccactcctccaagtataacagctttctctggtattgcccatattcctgctttctctgttaatacaacccatgcaccttcttcataatcatctgcagaaggaaggatagaagcatctagcactttcccagcatcataaggtaaatcaaactgataaagttgtgtagagtttctataataatgggagacagttgctgttccatccccagatattatgactgcagatcctgaaggcttgccccctatccgaagcctcatggaaaacaagaagtcttcgtcttcaactctagcttttggcattatcacctcaataggggcttttttctccaaaaccctgtcatttgtagtctctaaacccaaccctgatttatattgcatggtcaagagagagtactgcatgtagcttgaactgctaatccggtcattgcaaaaggttgcaacaagaatggtaatgactttaccatgatcatctacttgcatatcaagaggccagattctcttttgaccagctagatccttcttaatgccaacctcagcatctgttccaacaattgcctgagaccaaagcctagaaataggtatatcagaaccaaactctactctgaaacactgtatctcatggtctgacaataccaagaattgtgaatttgattcctgaatagaatgatgtggaaaacaccacgtcagagacctagggtacccaatattgctcacaatttgacctgattcaccctgttggagccggaaattttgatatactttccttctatgaatgccagtaggagtgcattgaaactgccaaagttcaccactcgagctacacacaagggcaacacatacaaacttacaactgggatcagcagaagcaatcatagagttaaatgtgtgcaatccactcaaactacttcccagcttactttgtcgccgctgcctgtcgaaggatgctttcccatcaggagtcataacagcctccagctcatcggaagacacaagactagtgaccggagcgtgtgactgagaatagatgtccggccagtatataacagcccgagtccgacaattgcacaaaaccacagcagcagagttgcactgtttagcaactttattcgttcccacaggcatggcgtcacaattaacaacacgaagcaaccaactaccagcatcatttctgccaacatcagcatcattcaaaggaatctcgaggacaacacatttgatggagttagcaggggacaaataactccataggtagaccctgttcccacaaataatccaagcaagggatgtgctcttgtcaatcccgccacacgcgtgatcttcagctgcattgcgttacatcataatctcaaacacatcaagcttaatttacttcaaatgtgaagggattaacacacgtgctaactaacacaattgagagacaaatcaaacagttctcaccaggaattcgcttgtgtagcaaaatgttctgctcatcacgaaccacttgcggaaactcgccgacgaaaacaggtttggtaggatctgtatcgtcgccttttccacttctgttgatctgaggaaccctacgcaatgaaaacggataacagttagaagcagaaagcgaatcgatgcagattttggtgaagaagtgaaatgaatgaatgaatacctggcaagaacagataagcgaggaacccagggagcgggagtgccggtggtcgggcgattgggaacggcgttatcgtggaaagaggttcgagcaggagtgaccggagaatctaccaccgtggaatcgcgaccttgctctctgcgagagcgaacattgctcttcttcgttccgcaagaaaacatgatgatgatgatgatcactcagtaccggcagattttagggtttatggggttttcgccatttgaatcacgagagggaaaatgaagaaaatgaaggaaccaaatatcgggttttactttttaagtgtaataaaattttcactcataacgtcttcatttttttgctaagggggaattctttctctttaggcacttgtgttcatgtaaatttgaaattataaagatgctaaaatatctcttagaataaaattattcaaagacaataaaaagacaggttagatgaaaaataatttataaaatatatgattatcttatcagtttcatatttaaaataagtataagcacacattatagtgttgatatcattcatacggaaaatatattctctagttaaaaggttatatatgacttaattttaaccatataagcaaaaattacttgttaatttgtatgcataaaacttacattttctgtgggtgttgcattgcatatatgaatataaattacactcataaaaatatgaatataaatgacggttctaactcactcattcttgtaaactcttgattattagttaaagtttatttaaaaaattataaaattatgagtgaaacttagtaaataaaaaaaaatctacaaaaatttataaattatagcaaatttcaactaataaaaaaaagtgttgaagaagcgcattattactcattagcatttgtcatgactagaactacaattgtcgactttaaaaaaaaaataaaaaaactacaattgttgaaaggggtcctaattttgtgtatttgctactgtggtattcattatcttaaaagcaattactattaaaaaattattatatgtaatttatttatttttgaatagccatgaccgtttttcataaaagtctctgcattcaatgcgaaaccgtttgttgtaacccaaagaactaacaaatgcgaagggatgaaataaataaaggaagccaatttcgtctgacgctgggttacggttcaagcagccatgtataagcgaggataatgaagcgtaagagcatgaggcagtgcctgccgtagtggccagtcactactcactaatgaaaggtaaatactttgataatcttgaattttttttatttttttttacgttttagtttttctttttttttttttttttttgtccttaaaatatctaaaactttaaacagtaaaaaatagttctttgaacaataaactattatttaaaataatttaaaataggacgaaaaaaattgcacacaaaaaatgaaaaaaaaaaaaaacactaaattataaaaaaaaaaaaaaatgtatttatgcagtacatataataagctcgtcatttgatatcatagctcaaaatttcattttcaagatgacaaatttatgaacaaatgattagaagaataaagataacgggtattggaacttgaagagaaacggcatatatcgtattttcgttcacatataagagaatacataattacacagcaccggaaattagtgcacaaggaccttctactgcataacagttcagttctccagaggagaagaaacaaccaggttttggaatcaaaagcaaaataaaataaaataaaataaaaaaaggggggctagaaaaagttctttcctatcttttgttttctaggcaaaaagaaatttgctatacgtacactggtacacatgcagaggtttaacttattgtattatcatggttccagcttcaaggaaacaactcttgattgtctgttggattttgcaacctttaagaacactgtagataggcaagccggtgcccaccatggccgccgcaccttctgctcccctttcagacaagccactacagacatcaatatagcattcacaagttaggagtattaacagataaagccatttttttcaactttaccgggggtaaacacccccctccctcccccccttcttttttatgttgttgtcacaagaaatatcatcttgcaagaaaagtcacaacacaacaaacagaagcagcatatgcatattttgatgtctccttatatataaacatatcacatgtttaggaatggacgtcttgacaatcaagttctggatgactccagcctatataataatatagggtttgattatgtttttggtccttttaaaaattcacaaatttcacatttgattctcatttttattatttttccaaatgagtcctccatagggcatgtttgttaccaaatgatttctttgttgagtttgatttatatatttattgtccatgtaaaacgattttacatacgcatacaatatgaatttatcctaacaatgcatattaatttaactcttttttatttttcccatttgaaccttcttaaatactatattacaaaattttcatctggtccctctaaatgagagaccaaatagaaaattctttacatttagagaaactcctgatatctccaggaatcaaataagaaaggaaaactgcacaacctagtgatattttttcatcaggtaaagaaaaatgtcttatgagaacattaatttgaaaagaaaaaaaaaatgggaaatcaaattggaaaatcacaaaatttttagtgtctaaaaacatatatataaggaagcgatttttagaaaatgtaattcacaaattgtcttgatactcacaatatagaaaaatatgtgctatgatgagaccctttaatggttgtctgtaatgaaatgacagcagtaccaacaacttataggcaagttatctcactctaatacagtaatactaaacgtctactctaatctttcttctagtacattcatgtttccttatagattgttcaaatagtacgaaactgattgtgacaacatcaatgatcatgccttacctaaccatggaaagagcacaaaacagataggtaaagatgaaaatttcaaatgagtttattgacaagtgtttttctgtttactgtttaaagggggaaggatagagagagagagagagacctttaatccgtcttaattccttgcacaatgtgatgaagtctccccacttcatgtggcaacgtcttataaaacgtaggatctgttcagtcgtaaacatggacatgccttccaggtattctccattaacaccattttctttaaaaatttggctgtaactaccaagatttatagtctccagccacaatccaacatcctgataaaacatgcaagataagcaagaatgcaactgttagtttaaattatcagttacattttgattctgccatggagatgcactatattttttttatttttttttttatcagcaaaaatatgtatatatatatatatatatatatatataaaggataaaacattacaagaaggaagtagaaaacaatccaggcataaagaaaccagacctatggtagcttaatacatgagtagggcatgaattaaactaccaaaagctggctggattgtgtacaacccttccctagatggagacgcactatatgatatgtctgtgtaacagcactcacatgttatatacaccaagaagaagaagcaaatccaaaagggtttatacaacaagcttagatccttgtcaacataggtctaatgtaatttgcacaattcatcatacagaaacagcagcataaatgaattaaaagaaaatatgtggaagcattccagagcttactacgttatatcagtaattaataacagtgcatcaattatactgtagagtctagacctgtataacagtgctgaataagcattattgaacactcaatacataagtagaaacatacacaatacatgagtagaatcataccgcaatcttgtgaccttgacacacacatcaaaggagaataacaagatgatacctctttatctgtaatagtttacacttcagatacatgaccttaataacctacttaacagagtaactgacaacaaggataaatcataagctggccacatcactgacagaggaacagggactaagggcataatcaagacaaataatatattggcaatctagtttcagatgctatttttccaaaacatagttgcaacaacagtgtttgaaaatccaatgatcacagaaagatgcatatagctttgcagtggaaactcatcaaacgaagatttacacttatgtttgtgctgcacaaaggagtaagtaagcattcagtgtaatctattattttctttgagagaataatgtaaaagccctcactttaaaatgatcatagaaactgtgagtgtcaaactgaagaattgaacaaagttatctggcaagaattggaaacttaatttaaaaaccagataacttgtgaaaacaacagggaggagatgagattcacaattaaatgaaataattcacgcacaagtttgattagccaattacttccaagttgagaaggacttcaacatcatccaccaaatttcccacttgattagacaatactatgttcaactttccaacatataaaaacaggtttaatctcagtctttacttgtgttatcggagaagcaaacgaatatcacaaaacagactatcgtggacaaagttcaagttatgtacccaacaaatttagttaaactaactgttgcaaaaaacctaattacatgttaaaagtacaaatcacgtaaaaagggatcacaactcacaaggcgtggttttttattatgagaaaatgtaaataaaaattaaaaaataaatacatcaattgacaaagggaatgaaatgattaacctcaacagtccagatgaagaaatcaagaggctccggtgactgtcctttgttcatttcccaaatcaaacttcctcaaatacacctgaacagagaccaaacaaataagtaaaatcccccaccaaaaaaaaaacagtttttctcgaaaaaatccgtaagaaacttttcccagttaagtaaacgataaagggtcgatctgacaaggagaagattggacaacccgctaaaatggaagccccaattacaagatctcaaggactaatttattgaattaaaggagaaataacaaatcaaaaaaatagtataaactaaatatgcttaccactttgcgacagtaaaaattgggttaagattaaaaaaagggaaaaagaaaaagatattctacgtttgatgtgaggaagaagacatggagaggagagagaaagtaagtgatgtgagaagagatgttaagacaggaaacaagagagggagaaggcttttttttcaactcagaattgcatgcttcgtgttaacgcatctgccacgcaccacgcgactccgttgcatcacaagccacgcgccagccttgccacttgctactcgaaaataaataataagtacattatttcctctaaattttgtgtaacattattgattaataatgtaattttgtggctgaatcatgactttgatgtttaactacctaaataaattttgcaaataagtctctagacatagttaagtgtcattaaacaaatgcagtaagacaatactagtacttctaaacaatatatattattttttctggttataagaaatatagatttattttcaaatgtattgattgttaattaattaattacttgtagtattttagcttacatattaattaaaatttataatttataataaataaatatttttttagcgtataaatttattataattaaaatatataatatattaattttttaacatataaatgatattttaaatttatgataaataattttttctgtgtatattattattttaattattaataaattcttttagtaaaatatttaaattcaagttagaactataaatattaaagatgatagattgaatgagataataagttaaattaaaccgttcaattaatatcaaaagtataagatggtatataaatgcatttttaggagcatttctgaattctgggcactgaatatacatatttgaaattgatttctcagttttaaagtgttaaactattcaattgatattaaaattttaaaacatagaaagatatatcatatgcattttaagatagtaaagttcatcatttcacaagaggagggtattaaaatggaagtgaatatgaggaagagatagagagacaaactagtcttaaatctttataataacaagggacttgatatatttttgtaactttaacttattacaaaatatattaatgagatattcatgtatggactttttatgtaattatttttgattaaaaattatttttaaattacatataatgtcattaaatataattactatttaaatcatttaattctatgagtatttgtgaaatgaaattaaaatttatgacattattaattaaattaactaacttaactattttctttacaggaggacgatagccgtgtgcatgggttgggtgcatgggttgtattattatcaagattgaaaattttcattgcgaagtgctaagcaggaaagtgtttctgtgagaattgaggtgttgttgatgagtctcataatgtggtttcgacgcatgaagaaatgttttttgtgcaaaattaaagataaataaaatgacaacaaatacatgtcacatatgcctttcttaattaaaaagataaagatcaaatgtcgatgattctttggtgaatgtttagctaaccaaagatattgtccatataatcgattttgcatgctgccccaaaattcaaggagatctttttttttaaaaaaaaatattatgtttaaaatctttgcaattttatttagatttaaatatttaattaatttgttttaacttattttaagaattttcttatttttaaagattacgatgatgataatatttaaattttatattgttatttaactttgtatattaaaaataaaaatcttaccatcttgtttatctaagatctcttaagtgtatggataattgttgttgtgtgtggaaaagtttttttaacattgtacaaattgattaagacatagaagacatcacatgtatctactatgagtttctaagtgaaaatccaaaccaacactataactgccattgaaaagcagtatatatgaaataggcttaaatatattttttatacctgaaaatagttttttttaattactacctaaaattcatttttggtcatatatgtacctggaatttttttatctttcaatggaatatatgtctttaatctcgttttgttaaatgataacataaaagataaagtgtcatttcatgaagctattacacttaacacatagccaaattgaaaccatgtcattatttattatttaatttattttaaaaattcaattaaaacaaatgggacttctccttctccaacggaaaacaacccagtgccatccaacctcgcgccaccactgcattgccatgaagatgttgcaagggatgcctcattccaatcacaacccttttgacccctccctagtttggtttcacaaagggtaggatcatttatcaactacaaaacacaaactaaagccccaacaacaaacattgtattcgtgagaaacaacaacaacatcataattgtaacacacacatgtgggtttggtgacaaacagaagaagaacttggagtagagcagagatggtgttgtggttgtcatggcaatcgttgggctccatgttgaggtaccagtggtgccgcggcagagttcgtcgacaatgttgacggcctagatctctgcgacgactgtgccctgggcatagaggtagccctcgccgacgactttgctagagagggagacgatgatgcaaccgaagttggggtgaggggaggtgaaggaagaaggagaagaaggataattgaattttttaaataataataaatgatatggcactaatatgttagtgattatgtttgatgacgtgacattttatctgccacatcatcacttaacataatgagactaacatctagtattacattgaaacataaaaaaaaaaattaaatacatagattatcaaaaataaattttaaatagtaaattgaaaacaatctatttttcaggtatgataacatatttaagcctataaaatatcaatttaaaccggctagctttcttcttggccaacaactaaatagctttacttgtgcaaatagcccaagagacaatcaatatttttagaagcaccgcaaataacaaaccaaaatatatttgaaatgaggagaaatagaaaagaaaaagaatccattagcgatatcatccgcggaattttatattggttgaacctccatatatcgtaccttataaagcaaagtgtgtatagtatttaccaccaaaggaatcaggaaatgattcgaaggaactcataataggttgttgcagttgaagtaatgatagtttgagacaaatgcggacaatgaaatgttttatagcatgtcattgagtcgcttggaaaggcttgctagttgtataaatataagagtttcaattttggaaactcaacttccttttctatttcatcaccttgttagttttcaaaaaatttcttcaacttggaggctccattaataatcgtaagttttatatgcagagtgagagatcaaaggttacaaattgtggcatggttatatgattagtgttggtgctagttttgggaatcatgaccgtggagaaagaagatttgacaatttctaattaccaatatcctcttcggtcacttaacactttgtttgtttcctatgaaagtaaaaggtgtgaatgtgaaaaataataaaagacaaatcacatatttgttttattaaagatgaaagtaaatattttaaaaaaaaaaagactcatgagccccacatacaagaaaatgcatctcaaaatgagatgaaaaacacactaaaaagtcattattattattttactttgacaaataaccctttcaagggccctcgtacatatggtgggccaacgagtgattgattttggatttgacatacagtcgattatgccaaatagatatcgattatatgcctttaattaaaagttttatttttttatttttttatttttacactttcatttattttcttacctttctatcaaacacaatgttaattttgggaatttacttatctacatatactctgacctggttttaaattggaagccacacaattgcataaatatacacataatcccaaaaatgacatacgacaacgtggactcatgtattaattccctgttttgttagatgaaaatttgcctcatatttattttatgttcgcacgtggacatgttaagcaaatatcaacgaattttaccaaatataaatttgttaaaatatatccttttgaaagttattttttttaaaaacatatattcatacttatggtgtagtgtagtaacactccatttgaaaaacaaaacacataggaatcaagctgctaatatcatgacccaagcccaataagaaaatggcgatgtttcaacagtggcgtaggcccaagcccagctgagccggcccactattgaagtctgaactcaagtcctaccatgttggttcagttcagttcaccctaaatttcttccactatcatcttctctcagtcttcattgtttgttgggggaaattcgattcggtttcgcaggcattgcctcgtttcgaaatccatgctatttctgtttcgttccttagaaaatgtgttgattgattcatagaaatgtgttttgcagagtagaatgtttgggacggcgattcgatgtttggcgaagaaaccgaagccgaagatgggacccgtgatcctgaaaacgccgccggagcagaggcagacaatcacaagaaccctcttcgatataattaaggagcatggtcccatcactgttgctaacacctgggaacgtgtccaggtactagtaccttcttagcttctctctcacattctcttcaatagtgctgaaaatagatataaacttgatcgggttttaggaagttggattgaaagatttgacaagcaagaatcacatgaaaatagtgctgaaatggatgagagagaggcagaaggttcggctcgtttgcaaccacgttggagcacacaaacagtttctctacaccacttggtttaccaagccggttacccctcccaagaatccctcttgaaagttgaaacttaatcatcagttggttgctgctgttttgtaccatgtcttgtcaagagtaataatttcatcttagaaccgttattcaatagagagaatctaaatgttttgccttattttccattgtttctgtctctgtgttcttcactcacaactcacatacctattaatgtgtgtttggatagcttctaaaattatcgtagattatggtaaggttgatcaatcttgattttgaccaaattttgcatgtttagattgtagaggaactttttgcaaccacgttgaagcacacaaacagtttctctacaccacttggtttaccaagccggctacccctcccaagaaccccctcttgaaacttactcatcagtttgttgcgctgttttgtacaatgccaagagtaataacttcattttagaaccattaatattaatagagaatctaaaaatcgggctttattttccgttgttttttcttcttcactctgttatttctgtctctgatggattgaatgatagtagaactttatgattctgaatttttccggagttatgaattttaagaaggctaaatcatcataaaaataaaagaactaataccccataaaaatagatttattaacggttaaaacatggagatcatatctattttcatgtataaatctcttgcaatttgatggttaaacttaataaagtgaaagaaggtgtcagctagtttatgaaaggatccagaatttaatgtaacacttctcattttaaagcattagtttgtttgggttggtgtgtgtttctggatgggtgaatatccttttttaggggtaaggtatgtgccttggtgcatgtttcgacggattgaaattacgagtttcatagatcatcatctaaaaaataaacttcctagcatcctcgatagtatatgatacagtataatatgcttaccagaattagaggtttgcatcatgtcctcgatagtagtcgttgaagttagtgataactttgaacaattgtgcacaagaaaattaatcacgttctgaaactatcccttaacagaaattaacgaggtttggctgttgtgttgagactacatgtttcagttttggaagcaaaacctctactcatacctgctacaccttcaaacacttgcatgcactggacgagaattttgagattgagagtgtgacaagatggagtttaaactgtttgggatttagaatttgagatattttcattttctttatcgtccttaatgatttactccagttcctctcaatgttctaccactaggacctttaacagaggtatcattctcaagacagagatgcggagaatgatagcctttagttttggacaattgcaaatgtgtagtttatgaagatgttgaacatgaaggctcaaaaaatgtttggaactcgtccatatataccttagctctggtaaattgaataaccttaatagtgaggacttctaagttctaaccgttgattggaaatccctcaagatagaaaatttctttgattttagaggtgttctcaataataacagatactaaattttgcttaatagtcataatcgttgccattgaatccagtaaaagcatattaattatgaaatctgatacaaatattaaacatttcacattttaagagaagtgactaaatagaattattgtcatgcttataaaacagatagagtcaacgttttagaactaatgatccgaatgggtaaattattgatagacagagtagacaactcagcatcgtttataacaagcagttgtaaggatgagcatgttccaaaataattttctgagcaaatgccgatcatatttggcaactttttcctaaacaggaaactcaatttaggacttgttttgacgttccttatccaatggtgtgttatagacttatagctgattgcaattttctatcttcagctcttttgattgtgaggtaggcctcctaagagcgctggaaaatagcatttggcttaaaatattatcttaaagctggaaaaaacaattgggttcaaagataattaattcaacaaaatatatatgtttattggtacatcaaagtacagttaattcaagaactgacctggtttaatgtttcttaaagtaaatgaaagaattgaactgttttcagcaaatgtataaaagataaagggacaaaatatttatctaaccataatttgcacaagtccaaaaacgataattatttccacagaaaatgctacataaacataaattgctcgcactacacgtcccaaaaagaattctacactcagaaactgacagtctcattcttagaagaattgcaaataacaccaaaatgtatatctaaggagaaacagaaaatccactcaaccaaagggtagggctagaacttccaaatcacaaaaagtcgaaacatttttgtttgggcatcaacaaaatcatcaagactctttaagttcatcttgtatgttgcgtagttcctgagccaaatgatcatgcatcttaagaagctcaccaattcgtgcttgtgcatggtccagccaggatcccttgccacaacacgttgacgcatttcatcaacatcatgacctctcaaatccaagttgaacagcttcattgcatagtttatggaactcgttttctctctgaggagtaacactaacggcactttcatttcgaaggaacaacaacatatctgccaaagtttccaacatccatgcgtgaaaatgctcactgaacttcacacaagcattccaagttgaggatatgctgctattgcctcgccagcagagcaatttgtgcatcatccagatcaacaaagtgtttatgtgctcccaatcttgtacaagtatttgcagaagctgataaaagtttaaggagtaggtcacatataacaaagcaataaaaagctattataagaaacaattcctattccctttgttttatccaataagtttgatccttcttggatttggatgtttttacaaagtgttattcctatgttgccttcattcagcttatcatcgttcaacaacctgaaaatcttgtgcaagtatgtcgctgccgctagactcagctgtgagttgccacaccactgcccaagctaatgctttctacaccagctgacaaagtgtttgctgttgctccctctgatggaggccccttctgaatgctttcttttcctatttccttaatattttgtgcatcacaaatgaataaaaatgtttgagccgctttaaaaaggtcagttgtttaataacgtacatcaggtgctggcatgacagtaatttgtgcaattttagtggttaccattgtttctccaagtgcctgtcggtctggaaaacctgcttcattgcttgattcttcatccaccaacttttatttgcaatactgaacaagcatgacaggaattagtcttactattaggaaatctattttcaagcttggtaattattaaactcgtatgcaaatgtatattatgtagagaagttgtcatataagttagagacgagcttctcacctctaaaatagaagttggtattgctagttttacagatgttgggacatttccaataatggttctctctatttcatcaacactctttacaatgccaaaagttatgctgatcagcatgctaactttcattgtggctattttaattacttccttcttctccatatttagtttactaatatatagttttccgaaagattaaaagaaaaaacatatacctctgtcatgtttggggaagaaatgggtgacaatttttgctccaacgtttgtggtaaaataataaatagaagtgaagtcttaccagattctgccagtaatgacattcttccgtgcatttttcccttctccaagcatccaaatcaaagaaattcattccataagtcgaaatcaattatacaagttggcttttgtgaatggaatgcaagaggtttggcttaaatgtactcttgccacattgcagttgtgtaattttgattctcgagtttcaattatacaagttggaaaaacaattgggttgaaagagaattaatttaacaaaatatatatgtttgttttgcacaagttaattcacgaactgaccccggtttaatgtttcttgaagaaaaagaaagaattgaactgtttctagcagacgtttaaaagataaacggatatatatatatttgcaaaagtcgaaaacaataataatatccatttgccacataataaaatgctgcataacaaacttaaattgctagcattacacgtcccaaagaacacagtagactcagaaactgatagtctcattcttagaagaattgcaaaatgtatttgtatgaagaaacagaaaatccccacaagtgggacacaaccaacgcgtagggctagagcttctaaatcataaaaagtcgaaacattttgcctgggcatcaacaaagtcattaagaatcttaagttcattctgtatgtcgcgtagttcctgagttaaatgattacgtctcttaagaagcttccggattcctgctcgtgcattgtccagctcaggatccctcgccacaacacgttgacgcatttcatcaacccatgacctctcaaatccaagttgaacagctacattgcataatctatcgaactcattttttctctgaggagtaatactaacggcagtttcattccggaggaacaacaaaatttctgccaaagattttaacatcaaagcttgaaatcgatgactacacatctcacaagtattccaaagatgaggatatgcttttattgcctcctccagcagagcaacttgtgaatcatccagatcaacaaagtgcttacatgctcccaatcttgtacggatatctgcagaagttgctaaaagtttaaggagtgggtgacacataaatataggatggacaagagacaataagagagcaataacctggagaaacctcaatgttgttattagaaacaatgcctattccctcttgtttatccatcaggttcaacccttcttggatttggatttcttgacatggcattatttcttggatttggaaatcttctgcaagtatgtcctttctactagagtcggtgagagtcataacaccactacccaagctaatgctacctacaccagttgacaacgtttttaccgtagctccctctaacggatgcccctcttgaatgctttcttttcctatttcctcaatattctgggcattacaaatgaaaatgaaaaaaaacgtttgagtggctttaaagttatagctatgaaaaggaagatgttttataatgtacatcatcatcatgcgctagtattactaatttgagcgattttagtggttaccattgattctccaagtgcatgttggtctggaaagcctgcttcattgcttgattctttatccaggaacttttatttgatatattgaacaagcaacacaagaattagtcttactattatattagaaaatatgttttcaaggctagtattattaaacttacatgcaaatatattttatgttgacgagttgtcatacaagtcagagatgggcttctcacctctaaaacagaagttggtattgctagtttcgctgatgttggaacttttccaataatggttgtctctatttcatcaatactctttacaatgccaaaagctatgttgattagtaagttaactttcattgtggctattttaattccttcctttctctccatatttagtttactaatatatagtttttaaaaagattaaaagaaaaaacatatacctctatcatgtttggagaagaaatgggtgacaatttttgctcgagtgtttgtaagtttgatgtctttttgttttctctctctgattcagggcactcgcctgtttcgaacacagttgctctgctttcaaattgcttatgttcacgtacagtttcagctatgcttccaagaacaaattgattgttatcattgacttgtggagtaggtggtttacttttggatgttgatggatcttctaggttcatttgaaatggagaagtgttttctggcacggaattctgctcatgctgaaaataataaatgagaaacaagttggactatgttcaacgattgattccatacaaaaatatgcacgtgcatatgatttatgctgagaagtaactaatgaccctgactgcgagctaattgattctaaatgagttgacctagtaatgtcattgcattttctaatgcaattccttctctgacacctctcttaatattctgcagaaattcaagaaatatgcaattttgtagcatactttcattcttcttgtaaaatgaaatgacaataagcatgtcagcctcaagccatttgaaagggaacaagcattggtccttgtttttgaattagaggacacaatcaatgacaattttctctgattgataacctttttgaataatttgttcattgggtttctgtagtctatattaaccatttcttaaatattcagaagaatgtgcatatttagttggtataacattatttacctgaggaattcctatggtactttcagtttttccaagtggcctttgttggtctgtaaaatatgatcgactcgttgattgcccatccaccaactcctacatgaagtgatgaattaaatgcttgagtcttaagctattcacttcttccaatatttataatagcttatggtatactcacctgtgaatgtgtttcacgttgacaaatatccaagggacttggggttggccttttattcagctctgaatttgttgaagttgcagtagcctgtacctctgaaccaggaatgttcccaatgaaatcgttctctgatttttcattaatctgatcaatgacaaaatatacaaaaagaataactcaacaagtaattttttttaataaatataatgaaattataaaaaacgaggatctttttcaattaattaagtcataacaaatgtagacaagatataatgaagcaatgacacgtattattatactgctgtcaaagtttcgtgaagtaggtgatgagttatccgatttgatgccattatcattgtgattgtatttaggtaggttaacttgcacagattggctggttctaacctgtgatgaaggcaactcactggtgccgctacttgtagaaacttcatctgattcaatcatattgcaaaacaagtggacaaagtccaacggtgaaagtccaatgtttttgaaatctgtaacaaaacattataaattaaaggacttcatttgacaatgaaacacagtaacaaaaatgcaatgcaacttcaactttccatggtagatcattatattgtcacaagtgtgtttgtaaggcattctggcagctaataagctacgctgactaacttataagttattctgacaagcttgagtggtaagcaagcttactttgagcatccacaatgggcaaaaaaattaaaataatgccttttaaataaaaaattaccaaaatatggccatttgaaacatatttccgaatctactgctgccaaacacgtctgggtaagacgtgttaaatcacgtcgagcttggacgtgttcaaacacgtcgtgggatggcgcgattaagcacacaaacacgtcctgtgtgggcgtgactttgcacaagacacgtcctgtatggacgtgattaaacacgtcatgcagggacgtgatttacataacaggaatccccattctctctgcatccccattctttcttcagtttttccaatccccaatttgcataaaagcttgctttagttttatagcttgtttgatcgtgtaatttcaaattattttgttgcaattttcataaattctttactatatgacaaaatatatgaaccaaaagtgaaatgtaaaacaaaatgattaataagatgaaaagaataaaaagatataataggtcaaattaattttataaaatcaaagtttaaaaacaattaccaggttatgtatgtatcttttatatcatttttttgtacgagggtatgtatgtatcttttgccaaaaaaaatattcagtttaagtaagattaatatgagtaatatattttttctttaatatttaacgtaattatatgtttaaaatttaaatttaaagcaacttattatattaaaatattattttagtgtaattagaaggtatctaaaatttctatttaacgcctaattattttccttttttatattcattttaaagtaaatatcttttgtcataatttcatgctgtaaaaaaataaactttagatgttgattaaaaaatcttatcatccgttagaaagatatgaaagtgaaagaaaaaaaataaagagcaaagaaaacactaattatgatgtattttttgtttgattgaaataaaaatataaataatggttgacttctaaaaaaatctcttacttgatttaatagacgaaaaataaaattatagaggaaaaaagtttgaaattttgacaaaatctcttgcaaagaggaaaaaatctcttactttatttttcgtctattaaatcaagtaagagatttttttagaagtcaaccattatttatatttttcttttactttctctccaatcaaacaaaaaatacatcataattagtgttttctttgctctttattttttttctttcactttgatatctttctaacggatgataagattttttaatcaacatctaaagtttatttttttacagcatgaaattatgacaaaagatatttactttaaaatgaatataaaaaaggaaaataattaggcgttaaatagaaattttagataccttctaattacactaaaataatattttaatataataagttgctttaaatttaaattttaaacatttaattacgttaaatattaaagaaaaaatattactcatattaatcttacttaaactgaatattttttttggcaaaagatacatacataccctcgtacaaaaaaatgatataaaagatacatacataacctggtaattttttttaaactttgattttataaaattaatttgacctattatatctttttatttttttcatcttattaatcattttgttttacatttcactttttggttcatatattttgtcatatagtaaagaatttatgaaaattgcaacaaaataatttgaaattacacgatcaaacaagctataaaactaaagtaagcttttatgcaaattggggattggaaaaactgaagaaagaatggggatgcagagagaatggggattccttttatgtaaatcacgtctctgcatgacgtgtttaatcacgtccatgcaggacgtgtcttgtgcaaagtcacgcccacacaggacgtgtttgtgtgcttaatcgcgccatcccacgacgtgtttgaacacgtccaagctggacgtgattcaacacgtcttacccagacgtgtttggcagcagtagattcggaaatatgtttcaaatgaccatattttggtaattttttatttaaaaggcattattttaatttttttgcctccacaatgggagttgtttaataggttacttataaaaaaatattattttgatatgtcacatatttgattttgtgttgtttatataagtaactattactcataagttgcttaaatttgtattaaatacaggagagagaaagagaatatttgagttaaacaacatgtatgttaattaagtttattaatttttttaataataactaccttaaaagtcatagtagtaatgagttttattggttgataacataattttttttcactgattgtgcctagttattaaacttatatatatagcttatgagctaatcttaccaaacaaatccatcagtcaaggaatgttccactatgcataataaggtgaagagtattttttttccaatttagatgacttctgtatgatggagagagtactttaaggaggtggagtaaggtgtggtttgcactaatttgggtaatttggttgggccgaaattcttgtacattcctagaagacacaaaagaggtggaggaaaaggtagaaatcataaaatattattcttgggaatggagtaggtttatgaaagtgtttaactattctttgttcagatggattgtaaatcccaaggcttgccttggtgtcctttagttgagacggggatcaatacaattgactactggagagagggtaaggaggtagaaaacagtggtggaagttagaaataaggtatgtggagaaggtgatacaaggtggttaacaggaataagatagcgaacttttttagtattgaagtgatacagtgcagggtagaatgaaagtggtacgcgtgactgtttaagacagacaaggccaaaaatggtgtgggtataatgtttgctgcagctcaatgcatgagatcataaggcaccaatattgtacgaggatgtttgcaatggacatacacgatatgaacatctcatgattatcacacatatactattctggtctcaaatataaaaataaaataaaattattcacactaatttaaaaaagttaattaattatatttaattacatcaatcttaattaattaatatttttaacttattcttaattgaaactaaaacctcaattaaataaaagatattttaaaaataatatcattaaatgaaataaaattaattaaatttttttatatttaaaaccaagaaaaatatgtattttttcttatatttatgataaaagaaatacattatatcctattgaagcaaaccgttgttcactttgtttgggtggcaagctgttttttgggacttgcgtagaatacatggtgggctgtgggcacgtggttagaacttagaaagaagatacgtaacgggtgacgaatgtatgagagattaaatcaagagaaaaatgatatgtttagatgtaagtttttttagaagtatttttaaaataaaaaattaaaaaaataaaatgaatttctccataaatttaaatgagttttttaacttatttgtagatatcatctcatcttttagaaaaattatattagtgaatttttaaaaattagttaatgaagaatttatatttatttataaaaaaatttatctcttttttttttcttcttttaaaaatgtttctaaaaaagtttactcaaacacgccaaaaacaaataatggtattttatcacacgtgtttggttgtttccaggggtggagtgtaaggaagcttaaaatgtcatttacatctttttttgttgttgtaggggttctacataagccttggattagaggtactgtattgggggttaactgtgtgctgttttggattttcagatcttaacactacttgtgttaggtctgtttacatgctttataaatgtatattttttcttttaaaaaaaacaaaaatcttaccaaacacttttttatcacgaaatttgaatgaaataaatattttctttaggtggaatgaggaaacgcaaattgtatgccaattgaggaaaggcccacatcaaaccatggcaatagcatatgcactacaatgggataagggacaacgattaacatgattagacgaagagttcatattaaataactgtatttgaacacatttagcgatgcaatgcatttacctgaataaggagtatctgcacagagctcccgaagagtagtcgttgaagtcaaagagagttttggacaattgtggacaatgcgatgctttacagtcagcaattcagtcccttggtgaagggttgagagttgcataaatattaaaagtttcagttttggaagctcaactttggccttttctatctcaccaccttttcctcgtttaaatccaataagttcttctagttcagtcgctccatctatgatcagaagctctaggttgggaaggtcattagatgcagatgcagagaataaatgtttcaacttgtggcattgttcaacaaccaccacttctagttttgggaaacatggttctagagaaacaagatttaacatttttttatcttcttcgatgatctgctttaattctttgcattgtcttatctctagacgcttcaactctgataggcatcttaaaacacacagaggaaatattacttccaatcttgcacatctcgttatatttaatgttccaagatttcggaagctaaaagaattcctggaatatccttgttcaaatccaataatctcctctagttcagtggctccatctatgataataacctccaggttgagaagatcactagatgaagacgcagagaagaaacgtttcaacttgtggcattctttgacaaccaaatctactagttttgggaagcatggctgtgtagaatgatcagacaattttttatcagtcacgtcctcttcgatgatctgctttaattctgtgcattctcttatctctagatgcttcagttttggtaggcatcttaaaacacacgatggaaagattacttccaattttgcacattcctctatgtctaatgttttaagatattggaggaaaagtgaattcttggaagccacccaaatatatgtcatttgaggtaggtcgcacaactccaacttttttaacttcaatcgcacttgttgtccaatctgaatgttttttcgctgaagatgttcaaaattattatgagtctctttatttaatttcgcctggcatccaacaaaagagacagataatatatgttgtaaatcacacccttcgatggatagccgtttcaaacctaagaacattgaaatatcactctgaaattcacgatcatcctcaacgacgttttccttttgatttttatgacctctttcacgagttaggatatgcttcaaaccatcacaatcttctataattaattcttccaatgaagtcaaggttttagccgtggatgccgtaaacaatgagcccaatttcggacatgatattagctcaagggttgtaaggctggatagagtaaacgatcctgaaaaagcagttactcataagcaaaacattgccatgcatattagaatcaattatataaatgttatgtcgtcaagttacactttgatttttaaaacgtttttttttttttggactaaaacaataaacacaagcatcaaattaagttaataatgaagaataaaatcattctaggacaatattcttatgctgattcatattatgactgaccttatcttctaataattttatatggaactaaaatgttaaaaaatgaaaatgtaaatcttctttgaccatttgataaataatgtatgcaatgttctgacaattagattgcttaaaattttcatatatgataatagattcacaatttaaatgtgatttgtaattgtacatgtcaataacttcaaacccaaacacataccttataaattttaactaaataattatataaaattataagtgtaatataagaaacacacttattgacttaagttcaacaatttagttcttaagggaggaatagagctattattcatttgctaaaattttacggaaaccccacttgataaaattaaattataatgattattggcaatatttaagaaaaattatctgcctttaatcattgcttagatcaataatcacttataatgattgagatttaaaaggaaaaaacttggaatgattgcaataaatcatatcaacagttcatgtaaaaagaaatgcacatatcaacagttcaacatactgttatgagtttttttacgatgtcacaattgaattcatgttgaatgctttgttttgtctaaccacaatttttgttgaatatgcagcccattacaacacatgtatatttgctaaaagcctataactgaaaacatgcttatgaaatgcaatatggaatgtgtacctgagctatggttcataagaggtcctagtggaattgaagtgctttctgggaaaatttccaattgattagcttcaaaatgaggattcaaaaactgttgatgttgctcatattgaatgattttatctaattcttgtttttgatcctggtgtgcaagtggataattcggataattcgtaacaggtggtgatgggacaatatcctcaactagttgatctagttgattgcaatcttttatcttcaacactttcagttgaggtaggcctcgaacagtattggctgagaagacatactttaattctctacatccacttactatcacttcttgaagattctggaagattgtggattgaacatgactttgagcaatagcatgcgtgaagaaagatgtcaactgtggacaattacttaaatacagcttctctaatttctcaagagggccagtaggaggtatacaaccgtgccataaaacttttaattgatccatcttgtatattttcagcttaagcaacttggagaagagaattcccacctcactcaaatgattgctagtgtcaaccaaacactctatctccttagaattacatatctcgagcttcttcaactcatgaatatctcctttttccaattgaaatataccagggattatattttttgcacctccctgagtatttgctatgaatataacctttgctgtttttgccaaatcgttaatcgccttatttgatatgtgaaaacagctaagcattagagttcttttaggggagataaaatttgcatcatcatcatcatcatcatcatcatcatcatggcattggcttcctaattttattgtataccattgcagttcttggggacactaaaggtgttaaagtatttaatggtgttttcattgtaaacattccattcttgctgtctattaatgatgctcaattcttctagccgtgggattctcctgaccacatcaaaattattcgtctccatgtcacatttatataacattaacgatttcaagttggttagttgtgcaactacaccatcattttgtaattcaaggaatgaaggcaaataacaatcagacaatgcaaggcactcaagtttcttcatatcacttataaatgagatgtcacttaattcccaattgctaaggattagacaacgaagttttttcaatgttttaaatgtcattgttgacaatggtagtttgtgcccccctccattttcaagatacataactctgagattttccattcttctgaaaatttcatctgatatttccaattttgtttctatgcaaagaaactcaagattggaacagtccaaatcatttggaaatttcacacaccatagatatcttactgaattttgctccaaagttacatccttctccaattcgcacttaatgagcttatcctcattctttgctatcaagtgggctacatcgcgatgaaagtcgtgcattttgacacatccatgatatgcatgcaacaataaacaagaactcaagagcttaattgtggctgcaatcacttcactctttgcctcttcatatgagcgaacttccccaactacacctaaccctattgcgcatcttgttaaaatttcagttggaagttcataatcttcagggaatacagaacacaacaagaaaagtgttttggcttcttcactatccaaattatcgtagctcaattgcaagcatttgtagggatcttgcaaacctttttcaatattcatcggcttagatctttttaatctacccaatgcaaccctccattccacttcagccttgcctttcaaagtgctagcaacagctgcaatggcaacaggcagccctttacattcatttgaaattaatcttgccaaatgctttacagtatcaggggtgccttctgttataagtgctttctcctggaaaagagcccacgcttcttcactagttaagattggcaagtgaatctttctttggcaatccattgaagtacaaactgcttctgatctagtggtaatgagaaccttcaaacctttatggtgttcaaaaagggaatccctatggcaccaaaatcaagcttctcccacacatcatccaaaatcattagaagcttattttcttcggttaatctcatgaataagcgttgggctctctccctttctcccgtttcattttctggaaacccataccccaatgaactagcaatttttgcttggatccttcgaacctctactgtactagacacaggcacaaaaagcactttgtcaaaaagaccctctgcttttgctatcttttcaactttcattcctaacgtggttttaccacaacccgccatcccatacaatccaatcatgacaacctcattatctttcagtgcttccattagtttctcgtaagcagattctctactgtcaaaatccatacatttttccgagagaatatcaagtgtgctagaaggaagtgtagtagtgcgttcaatttgaatatatggtccacctttttgaacgagcttttcaaggtccctagttttatttgctaacttctttcctacacagtatcgccaaatccaattcggagagtgcccaaaacaacaacttttttttgttcttgcctctttcagcaactgattcacattgtctacgtcattctcagcatcctgcagccactggttaacaacttcagcaggcgttctcgtttgtttcttggcatgtgcaacaaatttttggacatcatttttcgttacaatcaaattgcgctcttctttctcaagctcttcaatcaaactgttaaaacaacaaggataacgtaattgatttattgctccacacactaaatctcttgaaatagaagatgcaaaaccgtaaaggcattccatcaatttgctccactaaatgcaactttctttaacctgaacaaaaaagatgaacatcctacgtagtaagtttataattaattataaaaataaattatgtatatacatattgaacatatacttattagataaaaatgattttaagataatttattttgtttacaactttatctaaaaatcacttttatagtacaaaaaagaagttatggagttagttgtagtgattagttttaatgttttatatttaaaagatttaaatattttggagatccttgaaatatacttgaattttgtaaatgattcctgaaaaaaaattacttctcattgagtccctaaaacttcaaaagttttgtggaagatacatatcgttagtctccgtctaaaacgtgatgacgtgtccgttagttggacacgtcagcgatacacataagaattggtcaagtcagacctccaaacgaatgaactgttgacatccaaacgcgtgaactacaccatctcctcctccttcgccaccctcttcgccaccgtcaatggcttcctcacctccccctccttccatgactccaccggcaccgtcctcccctcctccctcccaacctactcccccctcctcggctagttccccgctcgtttctagcaatggctttaccattgcatgagatcctagtccttcaatgaaatttattagtataatttcttataccgtatgggtatctgactgagccgaatgctcataaatatccctagtaatatttttaggacattaaagcatatctcttctaaagtactcaagtatttggttaggtcgaatactcttatcaccttttcacccaaggtgatctctctgcataagtactcaggtgttcgattaggccgaatacccgagtactctaaatcaccttgtcacccaaggtgatctctctacataagtattcaagtgttcggctaggcaaaatacgctaatctccttgtcacccaaggtgatctctctacataagtacttaggtggtcgactatgtcgaactcctgagtactctcatcatcttgtcacccatgataatctctctacataagtaccctggtgtttggcttagccaaacacccgattactctcgttacaatgttgtctgaaaggggtccctgtatgtagtcaagtactcagacctagtcgaacacctaagctcccttgttacttatttggaaataaaatgtctagtttattctaaataatagtaattaaggattaatttaatcccttaatgatgattagaggaacattacctataaaggtaaccatgtgtaagagtccatggatcgacctactaagttatgtataaataattacgtgaatatcaagataaggacattattcattttcatttaatacacttgtttattactctcaatcgagaccttacttaagggttggagtatcttttgttgatatcccacccttcgaattattgattattatattgtgaaagaaagagattctcaagaagaagacatagggaagaaagttacctatttcatgcaggtacatttctattataattttttaaaaggaactaattaaaaaaaaaaaacaaattattgcaaagactaaaacaaataaaactgatgtattagtggggggaaaaataacacaaaataaggaccaaatccaagaaaagaaattttcaaggatgaaaagtaaaaataaaaataaaaattagagactaaaagtaaaaaaaaaaaaaaaagttatatcttaaagataaaaacatatttaagtcaaaataataataataaaaaatacgcatgttttatattttttgcattggcaggattcaaagatgagtctttccataggctctgaataagttgttcttataagctatttaaaaacattttataaacctgtcataagatgttaacataagataagttcaaataagcttttaaatgggcctaaatctaaccagagcaataacatggatttcattaaaaataggaattaaataaaaaagttatacagaacaaaatcaaaattagcttatttatcaaagataaaaatatacttaagctaattattatactaaaagagcaagtcttggtcatttttttatatatacctttctctaatttgattttatcttttcgaaaaaaccagttatagtattgctaaaacaaatattggttctctcaattttattttatttgtatttataagaatcaatagatattagaaaagtctgctcttatttttaaaatcagacgagtcaatttgactgagaatcgagttagtatctaattagttaattataaaagatggatcattgcgaaacttgtgagaaccaataaatatccggttaaatagatccaaaactagtaaaaatcaataaaaaaaatcatgtaaaaatagggttgaacctatatttttatgtttattttacatttgactaaaacaattttaagataaatggaaacatatatttaaaaaacacagcaaatataaattgtttcactaattattaatattttatttataaaacatataattcagtcatttatattagtttatcatttttataattttatattatattaatttatcattttcttttttattttatatgaaacttatcattattaatggacacatattttattaaaacttaaactaagtattatgtatagaaaattcatatccacttgttcttgtttttattttatctataggtaccaaagaattagcagatttagtagccctggggggaaggagcattgatttggattttggactgaacatgtcatccatgcaaataggaaatgagcaaaaatacgtaagcttacctctcctcttacagaagattcaaggaattgagttatatgcagagattggtgagaaacaagtgtagatcgatgactttacaagcaagagacggtgaaattaatctaggacagttgcgttacgccacaaacatatatatgatctgcagactcccaaaggaaattattatattagaatacagaaaccgcaaaaattgcaaattaaacaacttgctgccatatttttaatatatacaccaccttcagagatgaattccattgctcgaatctccaaagaaacaagagaataagagaatcctcactcacgctccactgctgcaaagacgattgctagcactactattcccacacgatcaactaatcattcattttaaaaaagccaagtcttgggtcttttgtcttattcatgctataaaagctttagtcttggtctttttttttttttttcacgagttattattatctacttttattattgttatctagtcgtcattgtcaatgactcattcacttgtcctgattgctcccttagttttgggggcaataacgagtaattaacaacataacaggttaaaatcagaagtgcccaataaatttcatgttgtactcactttttctaagcgtattattttgttgatttttattttaatgttctccttatatacgtgtttggtttaggagaaaaaaaaaagtgtatctaatttatttttacgaacacccttccttttttaaaagatgtagtaatagaagcctaaatttcatgttgtagtaagttaaccatcgaacgtcattctctactttattcattcaaagagcatcattttgttccaaggaaggtgataatgaactcaaaataggaacttggaatcttaagaggataccgtgatcaccaaatacattgcaaatcacagagaaaggggatggaatttgctagtcatatactcaggtaatctaagaaagtactagaatctcacactactaaagagttatacaagggactctcaactccctccctccctagattagtagattatatattattatgatcaatttacctccttctgatcaattaaagcattgtaagttacaacttacaacactaaaatccgcagttgcattttgaaattttatcacatcttaaatgtttttttttttcatttttcaaatttaattttcagattgtcaaatttaactacctgtataaataaattattaaaataaaatttaacagagacaaatggagagtatacttagaataacaaggagtacaaaaagaaactccctaattgttttatgttgcaaagtttaattatacaaaagattataagttaagtccaatattgaagactctttcttttcttgttcttatccatataactaagttctgagttgtgacgcactgaggaggacacactcaacctttcgactttatcttccatacttttaagatattcttgttcttctaccagactctattaattttgtatacataatagcggtgcaaagccaaatataatttgatcatcatcattttttatttattgaacggttgaaatcaaatttataacatattcttcattttttatttatttttttaaaaaaaatccagccttcttagtttttataaacctcgctttttgttttttaaatattcgttttaaacacgaggaaaattgctaatcatttgtaaatgatatgtttagaatgtgatggaattcaagattcatttcatagttttctaactcctgacgtttctttttagatttttaaaaattataattttcttaagaaaataaataacgaaaactaattattatttttgttgaaaaatgttattccaaataagtattaaaagaatgcaaatactgggccttatttctatttcactcagttgcttcattgactcctattagctatttgcaccttgactaatgcaatttcggaacctttcgcttcgagtatttttttccgggacataatacaataggtgtttcaagctctatgtggaaaaagaaacgtagaaaaccaagctacgtgaaaatattgcagcatacaataccagaaacaaaacactcatcatgaatagcacagtagttgcacaagactttcatttcagtaaacaattaataacatagtagcctccgaaagatgataaatttggtcctttaaaaaagcaataaacaatgaaaatcctgaagactcgagggatttctagcagcgatgggattgtgctcaaattggctacacagagcccaccatttataagcgaaataattcttaccgaactttgctttgatcttccaccatttttctcacattttcaagctcctttttgtaccctatagtttctgcaatgcatttcttcttttactctctcagagatgataaggcggcctcacagtctttcatttcttccttcaatctaatgaaccgttccttcaaaacttgttccttctgttgagcttcatccatgaatgtccctgcctcggatatttttgaaacgagtaatggctacctcgtcctcattccaatgagcttcaagcactgccaacttgtcagtggtagcaaagccttgcttgaaggaacatagaatgcttgggaactctctgtgcctggtgtctataatatcttcaagtccatctgatagagttgcatctttgaaaggaaggttggacaagaaattaagtcttttgccataattttgtgagatcctccattttgtgacactaaagagcgtccacaaacattgcaaataaaaggcagtttggaattgcttaaaaagttcctctgcttctattttttacaagcagagaggtcacagacaatggtaatctccaagtttaactaaagcaaggtatcttaattacttcccgtaagatcccaatatatttggtgcgatggatgctatttcacaccggttttgcttactttgtgttataaggtgttatatcaatattacttccagttctttttcttgcattgtagataatctcttagtactctctttacttattttcagttttacacgatgctcttattcttgttttaagagttttgtccctgatgaatttggtttttatacaaatcttcctttttgttttttacaaagcaaggactgtataatgtatactttatctgtatactaatattgaaaaaggaattaggcatccccctccctctttggctttttataaagtgaaaagcctaactatatcactttttgtttctcaatcaaactacaaattgtacataaaaatccgggagctacaaagtgatttcacatcagaagacaagaagagaacaaccaagttatggttgatggtaaactaatctaacaataatatacacgagaattaaaattacactagagcaatacagtttttaacacattgacacatacatttagacatttaacactagaaaactggtacaaccataaagatggtttcaatttctgaatggttagcagcaagccagcaacactggtctttgagttgcaggtttttcacaaactctttctggtgccatcgtaacttgtgtcttgctattgagactccaattattcaaaactctagcataagttgaatccatttttagagttatctaatatgatatatatattccaacagtttgaaaatctcatgacttctttgtgttagttcctctgctgatgattagctggaattggaaattgccttggggttctgctgatgtcacgtgcaatctcaatgcaagcttgatcaaccaatccccagaaattcttgactatgacaaatagttgactattgttttctgcaatctcttttgaagctccaccttgataatattgtgttactttactaagagtaatgagactgaattacgcaaactatattcccctactctctgttcatctgaagcaacattgttctcggactatccaacatatataagctaagaatgacaatcttgtatcaaatagaaatttacaaaagccagtgactatatattatgacattaacaaatgatcatcaatgcatgcatgactcagttttagtcttttagaagcaaaatcttgattctcgagtattcacgtgaactcttgtgctttatatctggcatgaaaataatctgtaacacatataacatcaataaccattaagtcactgtcatgcttctaaaataaatcaaattgccaaaataaaatatgccagtagttttgttagcacagacttatgctaataaactcatgcatggttgcagcttttaccttaaaaagtaacattgctgcagcctgcaggcatcctatggtttgattgatgaacatagtgtatatatcatgtaatactcttatcccttgaactcacgtaaacaatatatgcctcgggtttgatcatctgagtgatagaatgatacatctgagtttgtaagctgattgattaatgtatcctataagctaacacaatgacagaatgatacatctgagtttatattgaccattgaccgcagtcattgccaaatttgaacattgtcatatcagcatgtaaggtggtaggtccattttgattgtagggtctagtatagctcctctgaaacttttgaacattgtcatgtccatgtccatcctgtgaccccattaccgttgaaatagttggcactaactagaatacatactttcatatccattctactggcactagttagaacaaacacgtgtaacttcatcaaatgaatggatttcacgcccattttaggcacgtatgagtatgactgtacgaccaaatggactgcttgctggcactgccatagtttcaatagcaagaaagtgcccctcccacagcagttctgacaagttatgtcaagccaatcacgaggttgacaaattgaaaagtttgttatctaacatgtagatgtagcattataagtgtagtttcaataagagtaaacactagctttggtagtcatcactcaaaaaggttatcaacgttttagtactaagctcaacaatttgttttggaacccgttagtattcggttcggaaaaggaggatcagtgacatcaaattaacaattttctgcatacttgctcacttgcatacaatacaatacaataatcctcttaattcttcttttctctctttaaagttgttggatttaaaattgatttcagcctttaattgaatgaattctttaccaaccagtaaaaactggtcggaaatagagttacaagcaggcaatctgtcctgacctctctcacaagagttacagagaagaaactttaccaaacaagcaatcactagatcttaaagtctaccagacaaatgttacaaaataaaatttcaccttctaaaacatccgttgttaatatctcattggtctctaaccaagagagacatagtgtacagttaaatctaaaatactctgggaagaatgctaaagcacaacccaaataattgttttcactattgcataacctacaaagcatttggttctgtagcagcatgaagaagctcatctggagttgcagccggatcaaggtcccaacacctttcaggcaaattgctagcctcccccttcagcaaccaagaaggcacttgatgtgaaaagcgcaacatctctcttctgggtatccattttatggcactcttgtctgtattactctgatatactgttttaaatccagctaacttaataagaggactaacacaaacaccaagttcctccgagtaatcatccagcacctcaaccatttcatactgatgcctcacttcatctggagtagatctgttccaatccgacgaccaatttcgatacacagcccaaatatctccacttctaggatatattcggacgcaaccacctcgagcagccttctccttacttagaacatgagaaaatatgttaacttgatcaacagcatctgaattaaaagccctgaaatttccacaagatttggtaaaacctgaatcaagccagtttactgagccaaactcactatcagttttggaactcaagtaactgatgtgaatcttaaatggattgacagacacaacctcacggatcatacaatacaaccgtggcattccatcttcctcatcatacaaggcccatatttgctttggcctgaagcattcctctgacctatctttgtcaaagtcatgaaagtcagaatctgggacagtaattgacattggaccagttttcccattctctaactgtagaccagaaacattcagagctgcttttctacatgtctctcttcttacttgaccaacttcagcttgtgatttttctctctcattcagagctgcagctactgctgctgctgttgcttcagatgacaacttcatctcctccagtttcttcctgatttctttcctggctttctcaatcaacaattttctcgcgtcaaaggccggtgccatgtaacattgtttggtttgaacttcaactgtgcaggaaggcttttggcattgtcccatgctatcatttccgttagccactatcaactctgaagcacgttttgaacccttttcttcatagccatttctgaaactggctcccacaacaactttctgtttcttgtcaggtctaattagtttatcttcctgtggttcactacaggagaatattatgtctgaatttgtattgaccatagtctctaccatgtgatgtctcttatcagctcctgacttgacttttggtcttcccctcttcacatttccattggcctgatgaacagaatcagcaggtaaggtagctgatccattttggttgacaactccagcagagccccactgaaatgaaacattggggacgtactcatatccatgtccagaatggtatcctgtgaccccattcccattgaaatagggggcactagttggaacatatgtaactccatcaaatgaatgacttccatacccatttcctgctacatatgaccaaggacaatatggaaacgaaccatttgctggggccgccccagtttcaacagcaacaaaagtgccacgacagttcttacaagagagtcttttattcacatacttgcgcagatactcatactgaaccttacaagaggtgcagattgtccaaaaggtgtcaagcccaccacgaggggttgacaaattggaatatttgttataacctgcggcccctttagcatgggcaggagacaaattcgtctggttagtcccacccaactgcacatttctcttgagatcataagaactgcgcatagcactatctgatagccaagtccaagcctcagaaacaagcttaaatgcctcatcagctcccacacatttgttcttatctgggtgaagcaacaccgccaacttcttgtactgtttttttacagcctccttatctgcaaaaggttttaatccaagaatcgaatagtaatctagctcaccattatgtttgacctcagaagcaatgtaaacttcaaatgtggccaccatttgagatataccctccaatcctggacagagagttttagcctttacagcatagtttttagcaccggcaaagtctctcagagcaaagcgcttttcagcaatctctatcgctttaagtgcttcctccttgtttgcttccatgtaggaacaaaagatcacttcacaactgaactcttgaaacagaaactacgaccagcccaacatcttttccaatatcatacataacctcgtttccatctctgcaaaagttttgaaacaaaaaaaaaccaagtaagtaattttaattttaaaactcacaaaactttcatctgagatccaaaaacaccaactcaaacattttcacaaaattaaacagacatttgccaacatcaatctagaacttatgctccctattgttaccgagaaaccaagaaccctccatctcaaatacgccaaaaatgtggaataaaacgaacagatcgtggcatttagttgattgaaacacaatttttgaattttccacataaagcattaaactttactttccagtctatttcctaaatcttccaatttcaaaatcaataaaacattaatcaacgggtagaggtgacccatctttcaatcagcacccaattcacccaaatttgacaaaacctaaaacttttgcgcatagatcgaaagtcttaagactaaaacccccaaaatttatactcataatttaaattaattcggaaaaaaaaaggcagatgcaataaaaataatcacaacaattaaaaaaaaaaaaaaaactaactgagattggagacgataatggggtgttgaagaagagccagatcgacacgtgtagttacgagatgaagcaaaattgtgtgtgaatctcgcttcgctaaaaacaggaaaacacagaacccgatttgtatggacacagtggtgtgtggtaaatggtaaaggtgaagcctttgctatggaaaaacaaaaactgtgaagaaaggattcgggtggctctcggatccgaagtgggtccgattcggcgcaaggtggcggcgatgaataggagcttccgacaatcgccgatcagaaagagaagagaccaaaataaaaataggaattattataaataaaatgatgataattttcagagcaagtaaacgctgttattactgaggtggttggaacaagctaacgtgcaccgtaggtgcgtaatgactaaagactgcatagcaaatttattattatttattatttctttttaagaaaaaaagaaaaaaagaaaactactaatactttcttttgttttatgtttcgcattttttttattgcatcttaaatttagtttaaacttatatattttgcggaagttggaagttagagactgtgttctgtagttggtgtgaggttggatgatgatttggagaattatcagtgatgggcattgggcacttgtgaatgctccacattgattattttatattttatttttaaaaacaacaaaattatttaatattttcccatcttataaaaaaagagaattaatataagatattataaaactatttaaaataacccactagtctaatgatgcaagatttaatataacatttttatttttgacagttaataaagataatttaatcaattcaatcttataaataaaaatgaagagagtattaaattcaaatttgattggtattattgtagacattttaattggttagcattaaatacgtatttatggagtcataaatgactgtataaatgtaataattggaattgggtgtataatctatctacttttattttagtaatctaaacttcctttttttgtgtgtgcttgacttactactttcttacacacaaaaaagaaagactttatttcttcttcttttttggatgcaacatttttaaccattttatttcacttgggtttacaatttttaaccagtttggtgcgattgaacttgcaattttttaggttgagttctacttaaacttctgagttctgacatcgatttcaagttgtcaatgtcaaataatttggacttaaccagcaaaaatatggggtctctgaaatatttatttgggctaacggggaaggcccaatgacattcgtctctgaaagtaacaaccaaattaatgtaatgtggtgaccaaaaaaatattaatgtaatgaaggaccaaaacaatattaatgtatcggttgaaacttgaaatgaaatgatgttgagtacagaatcaaacggacaacagttgaatcttgaaaaatctggttctgccaaaaattgaagtggttggattggatgcatactttgagtcaatgatcacagtaacatgtttgtttgtccactgggttgattgtgtttgctctgtctcaatcaataagaaggacacttgttttttttctttttcgtattcttcaacactactcatactgtaaaataatcttttacggaggtgaattaaattaatcaacgaaggagatggaagttttgattttgacatttgaaaattttgtgctaccccgccatttcaaaaatagactattcagcaaagaatttttcaccttgatttgcccgtcttattgaatatgattatctagtaaaaatttgacgtgatatcatattttttccatgattgatatcattaaaatattacactttatgcccgctttgtatccgttttagagtattgtattgtagaatttgctaattacaaatattctcaacagttcaataagtttatatatttgaatgtctcatcagtaaaaaaaaatagtatcatctttgttttttgttttgtttttttttaagatggtatcatctttgtttttacttatatcaaaaactgaattttttctatgattgtctcaaaattatatgcttattaacttactcaaaattaaagcttagtctttgatagtttccgtgaaagttaagaagattcgctagccatgggctttagtgcacttaggtttgtttttctatttaaaaaacttggctatagaataagcttttaaatatgcctttaaattaggttgaacttttataaaagttgtacaaaaacttaaaagactaatatcaaagtaaataaatcatgttctttatttgaaaatacatttggtatatatgactggtagattcgaagacaaaaattgaagtttttatagtgacatataaattaggtgtatttctagctaactttatatatatttgtatctattcagtaaaaaaaatatttgtatctattttaatgtcagtttagttttaacaattataaatttataataatagatcatatcagtaaatatttaataatttgataaattttttggaacaaatttttacaataatacacgagtgagagaaattaaaaagaagaaaaacatatatagaaggaatggtgtaataaaaagagataaaataaaaaaagtgaaagtgtacgtaaaattatggtaaaattttgttatagaaataacattactcttttgagagaagagagggggggggggggggggggggaacacattgttactgaaaaagttaaaaagtgaattatctctgggcctttggagtgtacgaataacactttttttttttgtgaattacgaataacacttctaaactgggctatagctcccaattactgtaataaattataaatagttaatagaatatcaacggtacttcccaatttaaggaagcaaggagggcaactaaaaaaaagaaaaaaggaaaaggttactggcaaaatcaaattaaagaaaaataaataattttaaatcctcaaacttcattcttctacaaatttatctactatcttttgtggtaagtttttatatttttaagatattaaatattttatttttattcaatacttactataaaaactagtaagatgatgaagttggatgatataaaacattactcaagaaaaaaatggaggacgatgataggaagtaataaagcaaagtttaaaatagagtactagttcaactaattaaaccttggttaacaaaatcaattgattgtcaaatgaactacctagcttcatatacacaaataaaagataaagacccattcatcactgatccacgcttatcacaactttttattgatatgtgcattaagatataagattgatatagtgatggaagaagaagataaaaaatagttaacaactttaaatttatgagtaataacaactaataatactaatcattaatatttgctgataaaaaattctattataatataatataacaaaaatatgaggaaattaagagatgagaataaacaaacaaattggtgatattttaatttggtatatggtagacaaatcaataccggggcagtacgtgcttcttatttcctgggcaaggcagggaccaagatttgattattattttttttttttttttggtaagatatcaaaggaataatgagaaatggtggaaaaatgagagatgatgagatcagacgttgacagtgttgcagaggaacatgagggacgatgcggacgcgtcgctggggatccttccactcccgagcctctcgtagctgtcaatgcaaaacaaggagagcgagagctgcacctcgtgccgagtccacactcgcttcctcacccgctccgagtttccgagtcgactcagcaccggtctcacgcacaccatgtacagccgcttgtacccgcccagcgctaccaccaccgccctcaccgacgccggcggcggtgaggatacgtggcggaagcacaggtgctcccacagcgagtcgtcgttgcgcgtgaggctgcaccacagtcgacacacgcacgccgccacgcccagcgagggaccgtcgaggcgtttaaggatttcccggagaatgtcaatgttgtcgtttatgaagaaccgatgtcgtttctcttgctctccgcggtgctgctgctgcaccatagttgcggacatgcacgatattattcacagagagaggaaaagagaaagagaagatttatctagctagctagtggaagtggaatggttggtttaagaagaaagtgtggcatgtgaaagatggagcagcataaatgtggggtaacaatattaggtttcttgcagtgaaactgtatttggattctctagataaagtcccaagttttaatatataataaatataattatatagggaaaattttattaagagatcaaatttcattaaaaataattaaatatatttttaacaaaagattaattatcgacaaaaaaaattacaaaatgtttttggagaaaaatattcatgaataccctattatatatctaatgtgagaaaaagaaaaagaaattaaatattataaggattatgatgtaatatgaaaaagagaaacaaagaaaaattataaatattaactaaatgtttaaaaagtgagcataagtgtgtgggggagggtggggttttaagtgtgagaagagaagtatattttgactttttggggaaagaattaatgaataataaacgtgaacttgtgaagggagagaccgtttacatttgttactacgttggattgttgtttgttgttgtggttggacttgttgttgtgcatgtagagagagaaggttaattgtgagtatcgaggggagagaaggggccaaaaggaagttccaaattaaccaaagaactggaaccaatgcggtgcttttttcctcttgttgcttttctatataggtttcggggtgagcagatttggtgtttgttgtttttgttgttgtttgcattcttttccaataccttgtatcaattgaggaccgttgcggatcagagagagaagaaattgagttcgctaactttgaatttttctatatatgcttcgtcgtgctgttgcatgattaattgtcacccagtctatgcagacgttttgtgtttttttttctggacgagactttggaccatatattttttttcatttttcaaaataaagtagtataaagaggttaaattcaagtatactcaagtgtgaatttgaggcttcctacctttctatggggccatgccatgcctgtttcatcaccaaaaattgatctatcagttcagcctacaagtctaaaaattgggaaacctataaaccagaagcctcccacttgaataagtatgttggcatatcttattattgagtgtgttccatttcatagtagaaagcattgatcttgaattccgttaaacttaatttagtaaaaatataaatgtttgaatatattgttggataaaactatttttactttgattaaaatcctggtttgactaagaatgtgtttggttacacattatgcatgcatatctaatgaaattgtgtcatatacaaataaatgaaatgacgcgtatcctatgtttggttaggcgttgcaaccacatcaaatgaaaaatttagcattctgagacaaaaaagccaaagtaatacctaaattgcttctgcattgcgttatatccaatgttatcacagatacacacttaaaaaattataatttatagttattagaaagtcttaaacaatgtagttataattatgaatgcatgttatctaataaaattatttcaaatataaataaacgaggtagaagtaataatttgtaatttccttctaggtgtggaacttcacgtgcactaaaagtgataggaaatagtttttgttttgagttgaaaaatttatattaatttttacagcaaatttgtttttagtttaaaagaatctaaatataaattatttttacttgaaaatcaattttaattaaaatttattttacaaacactcatctaaacataaaatattattagtcaaaaatatattcttagctagacgtagtgttatgttatgtatgatttttaaattaagtaattaataaatttattatatatgacaaattattataaaataattataaaatcattttatattattaatttatcgactattttacctttatattattgtactatctttcatttaatatattatgtggtaaaaaatgttaaattatatttattcttctttattagttgaaaatataataaaaaataatatacaaatatcattaatatgttgactattatttgcatatatataccactgcaaagttggatatatatatatatatatatatatatatatatatatatatacacatacatatacacgtgaatagctggcatatatatatatatatatatacacatacatatacacgtgaatagctggcaagtgcgctgataaggttgaaaactctacattcatgcgatgcatgactagtaactaggtacaatatctagcaagagttgacctccatgtcaatgatcagacctcgatctatataattttgtaacattgtttccctttcctacgctccaagcaaaactttggattccaacagttttcaagatttgcttaaattatctttttaatttgacttataccttggactgattctaccaaatgtttcatttaattataaaaacaaagatacaactgatgcactgatgtaattttaaaatataaatatagtatgttctgtttttttttaatgaatcagatatcccttttccgaatctcaaggatcaaaatacttaaatctggaattaatttctttcaatatatttttttaacttaaatacatttttttatgcaatttaatcatttttttagttatatacttataattttttcaatttaatctttacaaaatatatttattttattttttcattcttaaaatgttttaaataacattttgaataataaaataaaaaattacaaaaataaaataaatactaaattttaggaaaaaatatatttatatttatattttttcatattcacatgttaagaatcaaacgcaagactatacatatttaaaggacaaaattattcattaatcatatcacatacagatgttggttggtctgctatgttcttatttcttgctaatgtttaattctcatgatatagaattaaaatgaattattttcttaatagctatgccataatttcctttctttttttattaaacttattataaaattcaaatcttaatgaatatgtaacgcaaaatgaggatatctttgtatttggcaagatgaactgcgttacttaattaattatttgatagaatatacattttaataatgatcattgacttgaacaactataatggtgatcgatgcaaataatataataatttgcttggatcaggaaattaagaaagatactctattaattaacttgaagacaataagatgaacttgtatttcccgttccaatcgagttggcatttgaacaccaaaacagtgcaattcagaaacagaaagagaacgcactggagcaagcagaagcagaaagaaatttttgctggtgaatggttagaataaataaatggaaaggaaaggaggatggatcatgttccaccaaagaagtgcctaaagtaatttccttccattgtgaggcacacgaatagaaaagtcacgctacagtaattttatgtttttgcacttgatgtggaatttgaatagcaacaaagaaagaaagcaagaaagaaaaaaggttttcagatgacatggtgaggcaatgtctcacggggttggattttctcccacaaagaaaagcaaaagccccaagtcctttgagacagaaagcataaaatataatttcatttagttagggtagggggggcttgaaattgacatttgatttattaattaggcttctgtggagagagactggaccccactcactcagtgctgcaatattagagagtgtgtcataagaggttgtttttattaggttggacttgttcgttggacacactcgaggggtagcactgttccctattcttgctcttagcaactcgataactgcaaaactacaaggagatggccgtaaagtaaagtttgcaaccaaaaatattttcaccgatattttttttcttttcttttcttccccaacaactatcctttgtactttgttcttgtaaggttttgcccacatactaattggtcaactagctagtatatgatcagagattctaccattgtcatgaccatacgtcaacatagagcagagttcaattatagagccaatcatctgtgaactgtggtccactgttaatgtgattatacaatctcatcttctcacttacctttctcctgtattcgtttcttgttttctttatcgtttaattaggactttctgatcgatcctacaaattattgttgtagatagatcatgtaacatatataccggctaacccaaacattagttaagatgaatattttatacataaatcataaaaatattttaatggctataaagaatagtcatgtgatgcttaaaatacaaagaaaaggtcaaaatggtatattcacatcttcttttttcccaatcgggcgcttctttggttaaaagtgaagtatacctcaattgtagttcacttactaaatttgattattcctataattataagactttaataaagagatattaaagtaattaattattataaaattcaacaatttcctattatattatacgtcaaccaataatttgataatttattttaattaaattataatttagaggtttgataaacgaaaaagaatctcactctaattccacttctctcccaagtaattatttttttcatttttcaattaaacaaacatatagaaacgatacacgttaagttttcaaaatcgctcgaaaatagcaggatttctatcaaactaaagttgtttatttttaaaattactaaactagtgtagtttatttacaaaaaaaaaaaaatcaatatgggtaagtcttgcttatattatttatttattttttaccaaatgccaaaaacatttatgactgtccaaaattaacagacattactattataaactgtaaaaaaattgcataaaaagtttaaaaggaaaccatattcatgaagtgcgacttacttatgttatgtgggtaaatttttaaaaactacacttgtttagcaataattttaaaaacaaaatacactaatttggcaaaaagacaaaaacaaagatcgccactggatatcatgcctatttggctcaaaattagagtacgtccaattgggtatcactccttgtgtattactctcttcttttttttcttttgtctaaaagaataaagtattgtgtggttattaatggtgtatcaatattatactaggttataattaattagtgttagagaaaatatataatagcataataatgatttgtgatctcgcaattagcagaagtatgtagtgataaaagctttaaacaacatccacagaacaaacaaacaagcaagtaaaaggtaaacagaaagacgagggggaaagcaaacaatgcaatgacagccagggttctaaatcaacgctatctcctaactactctcttagctaggagtgggtaactgtggaatctgatctttattttgaaaatttagctaaatgggttgtgtttttcttcttgtgtctttgcttttgcatgggattgaggactgatttattaatttctcattattcattccctttgatcaaggggagggaagaaacttcctcaatctggacactaaattcctagcctgctatctatcacaaatcttgggtacgtgagtagtgaaaagctctgacaaaacaaggcatctttaaaacagtgatgttaagcataaaatcaaataactatgtggctcagaggatgccaacaagtcatacaagcacaagggaagaagttactattagtggatccaaaattaaacttttttaaccatcaaattattaattcattagtgttacattgtcccaagctgtccaaaaagagaggcagagttgttttgcgcgcattgcagcttattacatactactgtatgtactaatttatggtagttttaactttaagccctaatcattcaagctgatggaaagtggacaaaaagctgtgtttgtgtgaataaaaactgcaccaacagaaggggcagtgccaggacattattatatgaataaaaattgtgttggtaaggggggctgatatatgctaggaaattaccagctaagaggagatttacttgaattatttatgtcaaattttgtaaaagttggacaacaatacaaagaatagttcttattttcatttatttttaaaatttgaattaggttaattttgatgtgcatcaaaaagatcaaataatttcggtttgatctatatgatatatctttttaattcaattataagttttttgttgaaagtattcaatgaaatgttattgaataatgtaaaaataggtataactaatttgagtcaataggcaaaagaagagtgcaatttgcaaagcaagaacttgagcatgtgattttgggactttgtcacattagtccgaaacctattaaggtaagatgagagtttcttacttgttgttaggtctaagagttataatttatttgacgaattgtaatttttattgttagtttttttattttttggccaactttattttaataaattaatttaaaatattttatcttttatttttaaaatattacaaattttatttttttcccgttaaattgacgtaacatgctaaaataattttactttttattcttaattttttactttttagttaattttgcttcaaacttgtttactttttagtgaattttaaccaaaacttttatacttatgtttcccctaattacacttatgttaattgttaactcaacaactaaaattcttggtaatttctctctttctctccctccctcaaaattttgacttgttttgattcttgtgtttgctatatctgtgtttccaatttatacccctttgattgtgagtgttttctctgttcaagccagccaacaaacttgataatttataatcatataatgataaagagtaaactaatgttagaatcaaataaaaatgttagtatttttcttcctctgattctagctccgcacacacagtacgctcactcaccacactcattggccattattaactaattgaaaccaccagatgtagtaggaagattgagattagttacttgttcgtttggatttttatccacacaatttggatgtacatccaagaaacaactagtagtgcgtgtttggaatttggttaagaggaaaggaattatgtttagattgtgaaagttataattgttaacttttgacattggagacttgaaaaattacatttaaaaccgtgaaaccaaacaagctttgatacaatttcatgtgaaatttttgtgaaaggtgaatgagtgattaggatccaaacatgtacttagtttgaatgatgtgataagaagaaaaaaaaaaaaaaaacaaagtgatttatacttgcagacacttccaccaatcatattaattatttttgtctcctcctctcatctcttttaaggttagagcatctttagtggtagatcttaaattgagatcttagactactttttggtagaccatataatactaaataggattaaagatctcttaaaatctctttcatttttttatttaatggtagatctcattttgagatcttaaggagagagaaaaatgaagaaaaattattttttttaaacaatgtgtagatcttaagagatcttccacaagacctcatctttcatgatggagatctcttcaattcctttattgggagatctaatgaagatcagatcttaagctcaagatctttgcttaagatcttgcactaaagatgctttaagtgacttttaatttaaagtgttccaaccacattctttcaaataaaaattcttcagtattaacaaattcttgataaaatgatattttacaattaagttaatatggttgagagatgttttattaaacgtgatcaattatattttttaacgaaaattaattattaataataaatactttacattaatgtcatggtgagaagaagaatgatattttactgttaagttaataatcattggcaattagtttagttttattcacttggtaattgaatttgaaaagtcaaatgctattgaatagtgtatgagagacgacagtgagacaggagggtaatttggactttggacatcttcatttgggccaaatgatgaggcccacaggctattacaatacgtgaatgttggaccacacagtccacaaatccaaagcatcctaaggtgggttgcgctaaaagtagaaacagagaaagttgctgagcacgtgtggctggcttggatagaaagaacattagaatttagaactagtagttgtgattcagtgcagaagaagctgcttaacataaatgggatttagaattagcggttcctcctcttcatcatgcttttctttgcaacgtacgcttcttcctccgttaacagcgatagccacttctactcgtgccttgaggatgaggaggagtaattgcataccaagttgttcagtatcttatcaaaagtttgttgagtttgctttggatgaaaccaaacgccacactcacttgatcccttcgcctttacaggtttctcttattcctttttttttttcttaaaaaattatggccattttcctgtatgtgttggactttgaatggttgattaggattagttagttccattctggtattgaatcccaagccaatgtgaaatttccgctttgtagttttttaaaacttaatttgcagaattcttcaaaccaaatttaggcagtgtttggtatatgtgtcagctgaaacggacaaaacataatatgtgaattttccttttatgttgcatttaaaaatacaacaggacttaaaagttgaaacaaatgcacattggggttctatagaatgtgtgaaatcaaggagaactgagcgaaatgcaatatttcattatgttttgtccatataccaaatgcaaccttaccttactgatgcatctgtacataatcgaagcaaattttgataaaatactttttttcttttttagatgaaagagttatatgttaggcctttttgccaacatatgtgacctttttgctttataaaaactaatttaaaaaaaaaaaactacgtaccctattgtccggagactccacgctatgcgcagatagggggtgggatattgtacacagctttacccttgcatatgcaaagaggttgtttccagattcgaactcatgaccaataagtcaccaagacacaactttataaaaactaataactaataattttttattggtaggcgtaaaactataactttagtagacttaccctttggccgaccctgaggaagaagagaaaaagaaattgaatgaacttctctatagaacaagttctctggttagtgctcaaaaccaagagattattaccatactttggatgacagtgtttaataaatataaatgaagtaaacaatcactttggtttggtcaatgtttaataaacatcttccatttattatggaagaaaaaacatgagatgaaaaagagttttattatgactaagtgtcatatcttgtccttttatatttttgtgttgccctgttgaggatgtggtgtactgttccaatcaccaagtttcagcttctcaggatagaactagctcttcaattaataagccgttaacttttattttcttgctgttattgagttattcaactttgtatttcgtttatattttgttatagtattattttaaatttagttttattgaacacataattgctttgaagattcttagttgtgaatttctgtccctagttgttcccgactcctctgctttgttcgcttaatttgctctccaccattatttgtgtgcatagatcttcaatctacatttttgtatgttgtcttgctaggaaaagttcagtttcatgaattccaaggatgttaaaggaagtcttagtacgctatcatttgaagctgcaaaaattaggcttctacgaagtttgatcattgagactgaaacaatgcaggtgattttttttttatgcctatcaattatcaaattgatatatggttggtatctactactgtcttaacacaatatgcctttgtgtagtaccttgtaatttattacagcaataacaatttcaaaatttgactttgtctgtatttatttctgccaatttcagttttctttttcctttaccaataaaggatccttcatctataacaatgcatgttaacagaattagtaagcatcctgttgtatctgtttcaatatgcaatctctgatccccatgaggtataacacttgtcggaatatctcataacatcaatattatatcttggaatattttagagtatcttagaaattctcttaggattagcttatgtgatttctcagtttccattttcctaatgttttatattttgcaattctatttcaagttttcaacaacacaagaaaaaaattgacatgtcattgctgaaatgttctgctgtcttctgtgtcctgtctgtggaaaggttattttacaacatgcttactgcctctcttttttgtcttcaacttcttatgcaggttttggattttactgtctttccaaaagcagaatatgatgtccccatattttgtgctaactttttcacctctgctaaaacaaacattgttgtgttgtaagttagcatcttcttccactgttgcaatccacttatataaatgtacaaaggatgttcttctcatattttacttttagttgtggaaaagtctagcaatttgggctatgtttgcaatttttaaacttattcctaaactgcatttcagcttatggaaatttatgcatgggaatgcaatattttcccatccaaaaagaatttaccattaattatgaaaacctatcttgggttgctttgcaaatcaaagtaggaatcattcagttttaaattaaaaaaataagccagcctttgatctatgtgaatatatactttcaagaggtacacacaacagagaacttttatgtcttcatttgggtgtggtaaatgcatatgtttcattgcctactaatactcatcaaagtaggttatcaagtatcaactagtctcagtaacaggtattttattatacttggtaaaagaaaataccatatttcattaggtgtaaatttacttgcataatcacttgaagaggatgtttcattcttttgttaaataggttcatgtatcttttatggtatatttctcattgaataaaagcatgcatttccagaaaagaagattgattgtggaggaattgtccacacgatgaaccaaacggagcttgaggggaagagtgaagttatcattttaggagcagatgtcctagatctcaatgttagtttaagcaagagaaatagtagttgttttactccagccctttggttttgctatttttttttcctatgaaccttgaaaaagatgaagtatagccctaatcagctatttcattctctttaaaatgtgatcttgaaaccatagttcagtaaatttgctatatttgtcatcttaagatatcatatgtcatattctatgtaaaggagattttagcattgaaagcatctttggttgactacttgaaattacattatatgtaccaaaaatgtccttgttggccttcgcttttcattttcttatgtattatagctttacaataaaaaattagatctgaagttgatgtatgctttaatttgaatttgtaggcttttggaagaagattggtattgactcctcttcatccaatcttagaaagaactatttggtgaagctgttataataaatgagaaaaaaaaaatgcctttatcagtaaatacaaactcaaggatttaatgtgtgctgcatgtctactaaagttttccacctactcagatgtggaagaatattatagtgtcatcctttttgataatctactgttagccttcttatgttgcattacttatccctcaatttaattgtttttagtcatattgtcagtgcatgtactttatataatggtacttgggagtttatacttggccaaaataacataatgaaaaagaccatgctttacctagaaataaagcctaaagcaaatctatgtgacagtctgtagttctcatttctccccaatattgtttacaccttaatcgttttagaaatctaatatttgttcactgacatcattggtaatgcgaaaaagttttcccccactgtgctattgatagcttcaaacattttttaagaacaaattactgtatgtaatgcagagcactaaccttgaattaattatgtcagggaccttaaccccttgcatgatatcatcaatcagtatgagtacaaggagaagtactttaaaagcttaattcctcttggccttaaatatgctgaggtaactgcaaatattttagcgaaaattataagaattattggtagaagtattttcagtttagaaacagttaatcactcgactgcataacaatgtgcaaagttttgttaataacagctacttattgacctgattagccacatgagtgatgcattgttctaaaactggatatacttttaagttttaatacgaattctacattttttacttttccatttagtattgattcattaaaaaagtcctcatcatggatgcatctctgtttttctgtaaattatagaaattctttcttaaatgacctagtgtgttgacttaacaccgactttatgcagctttttccatggggagggaagctcacaagtgagtccataaattttttttcgccaattgtcatctggacaaagtttacctcaaacccacaaaaatatgatattttgtattctgcatttagggaatattacaaggtaataaccccagcattatggtcaacttcttgaatgactattcatattttgctaaatactccctccgttcctatatataagacctttcaactaattcactctctttaataaaattgattaatgtagtttgtgacattaaatttgtcaataatttatactattttcaaaattacccttaatattttttaaattaatcatctctccctttccacttaattttttcctccctcattaattaatttttggagatagagtaatgattatgtaacttgtggctactcatcttctccaatcataataagagaaagagtttatcttgttaatttccagcatatttttttttgctaaaaaatttgtagttaattaaggatattttaggaaaaaataattaatacaagagacaagtagaaaatggtcttataaaaaggtacaagaattttctgaaaatggtcttatatataggaatggagggagtataatatatttagtgaactttaataaaactgaccttgtacacgtgtaatttttttctcttgatgactgttaccctggcaggtatggttggaattgatatgcaaagcagttaaagagacagatgaatctcagatttcccacaatctcgaagcacaacatagatatctgacatggagagctgaaaaggtagttcacagttgctaaattttctgacagccaatcataaatatgattgctgatctagccataagcaaacttatatttgtcccaggtataattggtttaggattttctaattcaccaaggatctttactcatttagttagcatcggttgaagataatttagatgataatattaacaaagatggttatgctgaatttgatatcttcaaaaaagctacctaacttattgtttctagagtaatgtagaaagctattttctagcattcaaatctcaacaataaaattgtcaaataagtttggaataaattttgaacttcgaactatatagaatatataggacatgtttggataaacttatccaaaaacacttttaggtaaagaaaataagaaggaaaaatgaaaaagacttctccataatctatttctaattcagttttaccttttaatggacctggttcatggacatacttgaaattaggatccgggacaaggtgttttgaagaagctgattggtgacacacttgccaaggtaggccaaatttgtggtcgatttatttaattcctctacaacctagtaatacacatcctcacttcctgttttatactaggatatgttgagaagctttctctttaatggagtcgatgaacttggaagcaaaacattcaatgattattttccacagtactgctgtcaagagggaattctaaataaaaaaggcaatattattgggaagtcctttgaagatcgcccatggaatgctagaggagaatatattggtaacagattttcaaattggcttgtctagttgctgctttcttttcatctctgcttggtgtgttttttatcctgctcctctattatcattgtgtttatgttcttccatcagggtcctacaagtaaaaaaactatgctgtgacctgcattttcttcttttatacgaaaattggttctgcatatttatctatgacattttgcatgtatatgttcgttgattacttgaagttgcttaactggcagtttgatttgagatgcgagagacattagggcttggattctattattcatgattaagaatgagatgatttcagtaatgaaatagttgtatcttttagcaagctagcaaatacttttgtagaagctagcacttacaagcatactacatatagcggcacaagcaatcttcagaattataatggtatctggggggtgcctggaaaaaaaaaaaatagacttgtgagaaagtagttcacaacttttataagtttaataagatttacagataaacttgttaaaataagttttttttaacttatctcagtaattctgttaattttatgaacatatttttatttggtaggagtatattaaataagtgcttaaatgaaattctttatttaaatgcatccttagtttctttccacagaatataaaaaaaaaaaaaatgcattcttattttataattttaaaggatccttcagctggattgacgtcgatgtgtagcctgaaggctaaggcatacttaccggggtgctgacatttgatctttttggaatattttaggtgaatgactgtatacagtagaagcttgtgcacacgtttgcagtcaaacttttactaggcatgccactggttaaaatttcggcgatagcggttctgcaagcatacaaaagacagctgcaatttttttagacaagttatgctataagatgcttgtaacagatatgctatgtcgacacaaatttttgcatggaaagaaatttctgtaacaaatctcaggctcagcacctatggctgtgcgtgtttgtaattttaacattcgtattggaagattctagttatatatctgcagctgtgtccgattagcttcaagtcctagatatttaagtgtaatactttaccatgcagtttagattaatttgtataacccaaaaattgtcactcgattcagtttttgggttaaatcaagaatttgttgaatacgattgggctatttatttggcatactggctaaattgggtctctttgtaatttgggtctttttgaagttgtgaatttcgagttgatccaccagtctcatttacttatgtctcaacctcaagcctataggttatgggaaaggtagtttataaattatctttaaccttgattcttaatttttggtttactggaacaatttatacataaaaaaaggattaatagcatgttttaccacaattttcattattttacaaattttactttaaagtattttttcatgaattttatcattttaagatttaaatttttatgcattttactgatagtcatgtgtcactaaaaaaagttattttttacaaaaagatgtcgttttgttatcaatataataatcaaatgcaaaaaaaaaagaatcaagtggtaaaaataaaaaaaaaacttgggtggtaaaatgtgaaaatttaaaatttaagtgataaaatttgtaaaaaaaaattgagtgattagatttgtaaaatgataataataattgaatgataaaatatacaattaatcctaaaaaatcatataactgtaaaaaaaaacggtctcctttattttcttccttgaagtacaatcttatgctatatgattttgatcatacgtcttgatgtgcatgagaacctaacttttttgtcactattgtacaaagcatgttgtgattgcagtttggaaatgtccaaatcttggtttaagttaaaaataaatagaagtttctatcaaaatataatttaagatttttcaactgaaatctaaatgaatagtttggatacctcttaaaatcaattttaattcccagaaattatgatgaaaaatttaaaaagttgaagcaattatttgttggtttggcttttcactcgatttaaaaattgattttgaaagaattaaaggttaattcaaacacacacaaagaaattcattttcagattcgagtttcactcgtcggtatcattatatgcggcagcccaacagacaataagataagaaaaaagttgaatagacaccttaaactcttatgtaatacctaaaatgtttaatagagtaaaatatataggtatggtaagattttttatatgataagaaaagaaaaataaaaaagtattggtgagatatttatatatcattattcataatataatttctcaaatccccatgtctttttagatacctaaaaagacagaaaaatagaagaaataggctatgataagtaaatacaatatgataagagaagaaataggaaaaaaataatcatggatctcatgtttacatgattgaggggttgtgaagtgcaggaaaaaataatattactctatttttatttatatcatgttatcacccgcatcacttgattctttcataagaaagaaaaaagaaaaagaaaagaacaaagtaaaaaatagaatgaataaaaatagataagaagtataatagaaataagaatatttggtttgagaacaatagtgacaaaataaaaggaaaatattactatttattttgctcatttttaaggagaaataaaatagtgagagtctggtttttttatttctcattcaacttatttctcctttataaaaaatatatatttcttaggataaataatcatttttgtccatgtctagagtgctgacaaattcgtttataaaacatgaaaatttcaaatttttatccccgaaagtgtaaaaaattcgacaaattcatcattccgttaacttctttctattaccattaatgaaagtgcctacgtgacacagagggacaaaaatgtcacaaaaatgattatcaacgtggctgctaactagattttgaacaaaaatgttagtaagtttcaattggactaaaatgtcagtaattttctgttggacctaaatgtcattaagttaccattagaccaaaatatcaataatttttcatttgaccaaaatatcagtaattttttttggcgaaaaaaggtcagtacgtttccatttgaccaaaatgtcattaagggtaaatcttccctcttttttttttatcattacaagcataataataacaatataataatcacttaaaaataggaaagcaagcataagttaaaaaaaacataatagtcactataatatttattaataatcataatttgtttgtcacaatagaaattatctaaaataaacattataccaatgtaccaaaataaacattgtaacaacatattaatcattacaaatttatttaaattataataattactcacaatctattgatatgcttgtctttccaaaataaatattataacaatgtattaatcattacaaatttatccaaattataataattagtcacaatctaccaagactgccccgccaccaagattcgaagaagtgaaatatgggatatacttgtcttttatttataatatattgtgactaattattataatttgaataaatttgtaatgattaatacattgttataatgtttattttggtacacagatagaatatttcttttggataatttctattgtgacaaacaaattatggttattaatcaatattatgactattattatgcttcttttaacttatatttgctttcctattttttaagtgattattgtattgttattaatatgtttgtaacgataaaaaagaggaaaagatttacccttaatgacattttagtccaatggaaacgtactgacttttttcgtcaaaaaaaatactaacatcttggtccaatggaaaagtattgacattttggtccaattgaaaatgactaacattttggtccaatagtaacttactaacatttaagtccaatagaaaataactgacatttttgtccaacggtaacttactgatattttgttcaaaatctagttaacagccatcttgacaattatttttgtgatatttttgtccttttgtgccaggtaggcacttttattaacgacaacggaaagaagttaacgaaatgatgaatttgtcgcactttttacatttttgaagacaataatttaaatttttatctttcagaaacgaatttattagcgctagacacattcaggaacaaaaatcactatttaacatatttcttatctttctttttgttttgttttgaatctttccctccatttatttcgcaccaatcagaacttttagattatgcactaaacagtacataataaggaagaatcaattagtggggttgtgaagtccccttgttttcttgaagtcacattttatgcatcaatatttctacatctcatgtttacattaatctttgaggtcccttatataattctattgctcaaaactctattattaaggcgtattttcacttatttttctactagtcttttgataattccctattcaaattgaaaaaactgaagaaaaataaagtaaaaacaggttctagctaaagaaaataaggaaaagtaattgcagctaatcatctctttcacacagttccgcatatattctgcaaaaaaaaaaaaaattgtattatactatatgaatgaataattcttgctagctacttcaatttattaaaaaactactatctcctaaattccaacaagaaaaaaaagttcatatttgaattgtaccatcaagtcgtaaagtgatccctccattgttcaagtgctcctagaagagtcaaaaggacataatttcatattgagataatgaagttggaaagacatggtcagaagttacattccattctcgatcaatctatgccatgcgcgtatttaaagcctaaaattaaatatgagggagagagaaacatcgaaggtgcagccagcaatatatattagtatatcagaagcaggtctatatatatagctagggtggctaaggtatgcattgcagcagtagcatgcagcagcagcagctacgatatatcagcagcagacagaaagacagaccagcagaagaaaagcattgtcaagcatagaagcaggagagactagggactagagagcagtagtagaggctaccaccatgcatgtctctacctcactttgtccttcattcattccctcttttaaatgccctaataaagaacttgtcattcatttttatcataagcttttaattttgtaactgttcatgcatgtacggcctttacatttttagttattctgtataactaaaacttcaaaattattttcctgcttacttgcacttgcggcgtctcttgcatttacacttacgtagtgaacagtatttatatgaattaatagaagcatgcttataaccaacgactcaagtttggcaccataatggtgtacgtactcccttgcaaacgcgatgatgatgtgataaatagtaaatgatggggtattttaaaaaaatcacacgtgtgatcaactttaaatttagatgtttattaggttcttttttattaggtataaatacaaattttgagatttctgacagggaagaaaacttaaaaccttttctgtctttatacattttttttttcattcggttcttaattatatggaaaacatttagttcttatacataccaatatagaagaaaacaaaacaaaactcatctacaaccaatgtacactagatgtctcagcaaatttaatcacaggtttggacctttaaaaggatggagtctcctgaaaaaaaataccaatgtcgtttagcacccaaaaatcagattgcattctctcctcttttttatcctccttttacctgactttgaaacatcatgtaaaattgtcatactcacctcaagttatgataatattgttcaaagcttgctagtaaatcaaccttcataatttctcataaatcactttaactattaattaagcaaaactacgtttgatatactctcatttacaagttccttgagccaccatgttaatcacaccatgaaaattgtcatgagttgcttgtattttcttcattcataaccatcatatcgaaaccaactaaaatccaaacatctttgccacatactcaaatgattgataagatagctttactcgattgatatggtgattaataataggtataaagaatagtattagacagttcagtaaaggtgttttaatttgattcagcttagaatggaagagaaaaaaaggaaattaaaaacaatgtagtttgattttgagtgacagagccattaatttctttcatttgatcaggttctattaaataaacttcatttagttaattttataggtcaaaagtcattatcaaatttgctcaaatgcgatgaacacgggtaatatagtaatagactcctgggaaccatgttaaaattagttttattttaaaaacggaacttaatgaaatataaatgtgttttattattaaataactgtaaaattagtatttattcctccaagttcagtgcccaataacatacaataattaaaaattataaaatatgggtaacaagctgaacacccaacaacatttataattgactattggaagatccaagtgaacgcatgcatgctagattgccacgtttttggacttattaaactctcaacatctactaggtgcctgcctcggcctgtcttctacgtagaacaaatagatagtgaccaagggagagaaggaaagattaaatgataatagtaataactaataacaataacaatggatgtgatttttgtgagagagagagataggtacaaaaaggaatgggaagttagaatgaatgtgagcatagtactcctaatactaataataataacaataataattcctaaacctaggtctaactaaggatcctgtacaccaaaatccaataagttaatgttattgtcaatggaagagatagccacgtgtctgtcattggccaccaagctattgacctctccccctctcaccccaagggtcacacacaaccgtcctatcgcttgctcaatgtcccaaaccctcaacgaaggcgaaggcgcaggcgaataggttaacgcgtagccaaggttaatgcaagcccacaacccgtgaacccataataaccggttcaaccgaaaccgactcaaccgctccaaagtgctgactcgccgaaccgttcccacgccgttcctctccaccaccacataagcatcctgactcgcatccagcgaactcaccacgaaccctgtcgtggaccccacgtcacgcaacaacacctccgggttccgaaaactgaaacacaccaacctcgaccccgtgcacgccacaacatactcacgctccgtcacgcgcacgcgccccacggcttcaactaactccgtcagcatatgccaccccataaccgtttctggatccgtcaaagaaccaccaacgaacacgcgctcctcgctccgcgcgtcccatatctgaaaagcccggcccgctatcccagcgaacaggcccacccaccaccggcccgttcccgcgaacccgaccagcaccccgttgttgacaacgtcaccctccacggcccggcgagcgtggctgggcccaggcccaggcccgttcacgttatccacgtagatatccccgtccagcctggcgaaggcgatgttggagttgaagataacaatgcctgagacggagcgtgagaaaggcccgaagaggtggccgtgtagggacaagaaggtggtgacgtgggcccgggtttcgaggtcgaagaggcgcacggtgccgtcgacgaagccgcacgccaggtgggtatcggagagggagaggcagcgacagagcaggttctggaggaggtggtgatccgaagggtcaaacaccggtgggtcgaaaaacctgtgtatccctgtcgagaagttcctggccgtccgatgccaatacatgtactccagctgccacgtggccctcagtcgataggtgcgtcgccatatgcgtctcgtgagccgctgccacagcagatccgaccgcgacacctctcgccacgtggaacatacctgcatgcacaattttttaacaaacctagctgtaagttaaaatagctttctaatgcacgcgaccttgattgataaattaagcaattccctagaattatttatccaaaaatagaaagcagagaaattcttttgtttataaaatcctgttgcataaaaacaaaagaatatgtatatttgatttttgtgggtttttttcttctgaactataagtaggtagaatggattaaaagggtggagagagaaactattgaagatggcagaagcaggtagctactattagctaaagctagcagagaggtactcgggacctaagattattagccttcaaatgaagctaagcttacagtacctagtagtaaatggcttctcatttaatttttatttattattatgtcagtgtacttattttcagttggatactttagaatcttagataataataatgacaacactgctatatggcatgccttacgtatgaaatatgcataagctcctacacacggaattaaattaaacaatccaccatgagctatagctataatcttgcacgatcttattgggctagtgtgattgtgacagacaaattatttgtaacaatgacaagtccatataacgaagtgcaacttttacatactagaataagcacacagaaaagatattctatggatatactatttcatagaggtagtcaagtaattgtcaaatgggtcaaaagggtgagctaggtctgactagtccagctagaatatgagctatctatcaacttgccttagaagagaaaatttaatagaagaaatgcgtagaaggattagaatatactacaatttgaattgagagtggagagatctagcaatgagtgaaaagaagacacagatgagatcagatcatggcttgtataaatgtggtccattacttagcagggatacggcaaaataacgaaactagtcaatatcttagttactgttcgtgtaggcatgtgtgtgtgtgtgtgtgtgtaatgtaaacatgggtatgaaaagcgtgcttccccacaaacatttcagtttcatttccaagaaaggtgtggccaaggggcctgtcttgtttcaaacagcgaatctctagttctatccacgcacacaaggaccagtccaagcgcccctgaagggaaacttagactagcaaaatgaaggaggaattttccttaattagtgttattaaatgtgaaaaaataagttttaaatatggtttgcatatttaataataaaggtacaggtgaaatttttaacaaacaaaaaagaatttttcataggtttatatgaatactttatacattaataattataatgtttataagaggcgttggtacataattttatccaaaaagatccacctttatcgagctgttatagtttttaagtacaaaaaattaaaaaatatgcatgccccaactcccgagtcccaactatgttgtgtgtggtgtgcaattatcattatcataacgtatatagtacacatcatatgatattagtatttaatttattgggaaagaaaactaaaattataataagtgtgaacttctcagataaaaacaaaaggaatggagtgtcgccacgacatgagtagggctccatgtgctttttggcattacacaaatgctgctttttgaccgcatgtatacatgccagtttagattataggatattaaaccgacgactaatcaccggttatttcaaatgtttcaaaccctgattgagattagagaaggtgcgaagtttatgcagcaaccaaatgcaattggtatttcctatcagaaaaaatatactcctatattgttactaatagagtagaaggaactttttatttatcaattggaaaataaataccagagtaggaggacactcttaaataaataatgtaactatgaatctcttctttatttgtgtgagtgtaatgaaaatttattattattattatttttgttacgaattaatgtaacttcaaatctattttccagatttcaattgcttggaagtacatcaactgactagtctaaccaggcaagcttattctttgaacacaaacgaatgattagagaaagctaattaactttcatactacagttaaccttctatcaactatctcaatctcaataatattatatattattaagattaagaaaaagaaatggtgtccttccgaaacattatatattaattatatatgcaaccaaactgaaacaagcttgataaaaaaaaatagtacattatcaatgctccaactatatatggaaatggtacacttacaaggacgctaggaatgagacataaataactatatatgcctccctcctaatgttattatttcagaaagcaacttcttttaaaacaaagtaaaaaagctagtatccacatattttgagatagaaaggcatgcaatggatcttctagcctagatagcagggaaaagctcagtcaaaaaggattcatgcccagaaagggaaacagcaaatcgaagccaatgtaagccttttcattggttgtgaaaaggaggtccaaaactagacatttttgaagaggaagagagaacagatattggcaagaaggaaaaaaaacacccttttttgaaagggacacacatttagtttgaaaaagacccacgtaaagtagctgctttcgcggaacagtttcttctcggttggttgaaagcatcttcaactaaaacctaaatcggcactcatctccccttatacactgagttgaataatgtatgcctctctaaagtttaaacaatacacacaaaaggaaaaaaaatccgaaaaaataaaataaacggatatgatatacacatataatattattaattaagttaaatccataatgtcgatattattattaaaataaaataaaaagaatcagcatctgcaggttgcaatgctaggttcacgtctgacttgaccaatattttgtccagtttcggaactgaaaaagctatctgttacgcatgctgaagattctacaaatattcattttaagcaaactaagaatccatcatcagattaagtaaggcaaacacaaccaaccaatatgagcaatcatcaaaaacttatctttcttaacaacttctctcatagcaagcaaaaaagttaaatggggctaaagaaattaattaagggggatatatattaaggtggtcttcaacctttacattcctacttgtgagacttcgataatacttgtatttcaaagaagaagaaagaaaagtacctacctgaaataaaatggcaagggcagaagcagcagaaagacgaccattgtagttggcagcatcaagggcaagttgggtggccaaagcttcaagaaaaggctcaggcaagacttcattcatagcacgttgacgctgagaggaggaggaagaagcttcaaattgaccactacgggtggttctcctcgtactagggccagggatatcaggggcaacagcgtcatatggggttgaagaagaagttgatgatgatgaagaagaagaagaagaagaagaagaagaagaagtagaagacatgagtgtgtgagtgaagtgtggaggctataaaagtggggaaggaggaccagaccagaccggaaagggaacaaggacaaaaaggttggagataaggacacaaagtgagggacccaaaaggaggaggtgtctgggaattcttccttatactatcatactatgtccatgtcttgtgtatctctaaatctctatacctagctaccactttaaaaccaaacctctgcatacaccatacacctttctccctcaaatttgttccactcttcaataaaataatcatatcgttattaataacaatataataatagtaataatatattattaatactatactatgctttttacatttatgatatttgtggtttctggagatgtttccgcactgcgaggacggctgtgggttggtttttcaatccagctatagcaactcaactggtgccatggtcttcaggtgtttttcaaatgcaaagtggtggtggtggtcctcctcctcaaactctccctcttctctacatttatttctttttcttgatcttctactttgtcttcaagtgcattttcgattcgtcaaattagtttattgtttttaagctcacttttcgattggtggaatttattattgtttttcaaacaaaagttggcatgtgtctagattaacttatttttaaattctttatgattaaattatcatgtgaaagatcccacttgcatgaaagtggttttagccatgtatatatgtataaataataataatggaatggaactgttctactattatttgttttcttttcttttcttgttcacacttagcaacacaatcatactcctctaaaaaaacaaccatacttagtttttgttaatcatatagcctttattaaaactaagaacttgtcattttttttaatctccaatcaatttttttacaaacaataaatatttataagtaaggatgataaaatgacaactcggcccattttagtttgcttggtcattaatctgccaaaaatgggctagaatggattggtttatttttaatatacggtttgaaaaatacagcttgctcggcttaagggtggcttagctgattgactcgcaaaaatctatttttttaaataaaaactaaagaatataaaataaaatgatgtcctaagacataatactaatttctaaacacatttgcaagccaaaacagattgatgggttgatacctttttctcaacccatctaagaaagtaggttcaatggactatctaatagtcaaatctattttgtcacccatatctgtaacaaaaaataaataaaaaatgaaataaagtatttttcttataagtttaaattaatttatgtataaaaaattattttttagaagacaagtttctcttttaggttaaaattagcttacaataaaatcaactttttgaaaagttaaatgaatttttttttcattttatcttgagataaactttttatataaactatttttaacttatagaataaacttatttaatttattttttatcttttaagtatttatgcaaataaaatacaattatagaattttatcactactttaaaatatacaagtaaattcagttcaattgataaagcgcatgtttgtattacaaaattgtcggcggtgtttgaggcagaatttaaaagaaacaccttcgtatattaattaataataataataaaaccttaacttacaagcctatttagcttttgcgttcatttgtttaggaaagagaagaccaatgagctatagagagagtgttaaaaaatactgatagtagcaaacgataatcatttctctttcaaaaaattattcacttttttataaaatatatttttttcatatatggaacactgggtcggaatttagttgtaccaaggggaggtgagattcgacacttattcccccactttcggtgggaagattcaatgcgactaacttgagctgatcttcacgatcatgagctaataaatttttaaaaataaaaaaatctaattattttttttaataataagaaaattaaattaaattttaaacataaattagaggatcaaataaataattaaacctaaattaaattaattataaattcagtacttaactcttattattaaaccataaaccttaaactctaaattttatactaattgtagttagtttttttggttcggccttttcttctttttttcttgtaaaaaacaaactagttattataatataattaacatataaccctatttattaaatattgtaagaaaaactaaataatctaatcatgcataaacaatataagcaattagattaagtgcgaaaaaattaagatcataaatacctcccgtcattgctcactgttttgagtctttggattgcattgaagatctctcttgagttttctaaactcttattctaaagcactagatggtgtatatgctgatgtatataaaatgagttcagggacccaagaaggctgtagacacacttatttatagaccccttgccatcaaaggttcagttacggtgtgttaaaagaatggacgttaacgttgcagaaaaataggggatgtgggtagtggttagtttcctgaattattgttgactactatcaggttggttacaaatattttataattttaaaataaaaaccaacaaatatgtgattaggaatttaatcttaagtttgtttatcaaatacatttattgagagaagttaatttcttacattatctccaatgtaggatcttaataccaattcttacaatcttaaattattagcatcatatgtaaaattttaagtgaaatgtttaataacgatcaattctcatacaattcatatggtaatagagtgcaatatctaactatagccttgctttccacacttgaccgtctttcattacgaaaattccaattaacttttgcactgcgatcattcaagaaggaaagcacaacactagtgaacgtggcctttttccttttaattgtttccaacagagaaaatcttggatggtcagaccaataagcactaagacaaaagtgagcgtgaatttactgtccctcatttttgtgccactattatgaccagtacatatgatttacaataattattatccgttcacaatcgactatctagagtatagaatctattggggggaaaaaatttatatcttccaatgatagtttcaatttgttttattggaaattttttcgggtttcaggttttgatgttcgaagcacatgcataacagcgacaagatccataactttgcaactctaggggccaatgccctttatctttctccatttgttttgagttttcttgagtgtaagtgctcggacagattgaactggggtttcctgatttactgtaatgctcctaattttttctgtaccttatttacttatattgatcagaatgaggtttcaatagaatgtgtacatatatataaattataacctttagaaagaaaaaagtcttggacctttttacttattcaagtccgttattggacctagtctcttcacttttacatcattagaaaatcttcgtgaagtcaagattctaatcctatcacctttaccttttattctttgaagcttttgaatagaataacatctttatcctctgctatttgtccccctgaaatttctattgaaggagaaaaagaatttctagttccaacactatggttccatttgtcactgctgcaactttatattatttaatttaatttgtttaaggaaaaaattactatttcacggatcattttacctcaagagtttggagtactccctctattctttataatctttttgtatcctggcctcaaagttcttatagatactccatccaagcttgacctgcgtgcgaaaatattccattcgaaaatttcatctcaaaagaatggtggtgaacacctaatttttcaaatatcattcatcaataaacctcatatttaaaaattagaatttttaagtactatataaattcaaaagaaaacaagaataggtatatccaattgattttctaattttgtattctagttctacgtattcaattgaataaaacccataaaacacaaagttacacaacggaaaataaagatagtgaccaaggaagtatattagaaagtcatccctcaacaattttatcaccagtttgtttaaacttatttgttaaaataaatatttattttaagaaaataaatttttttaatatatttgtttaaattatttctgcttaaaaaggtaattttttgtttattttaagatttacttcttaaaaaagtatttataaaaaaagatttatttttaagttattttttaaaagtttaaacaaattttatttgcataaatcttgaagaaacccaaaccaataccacatcaacaagagaaaaaacaaaattaaaatgggaaattgaaattccattctctctactatcttgggtgaagggtcagccgtaaatatctcatcctaaatacctccaaacagcgcagctcttgcccccccttcacgttcattattttctcgtgtcacaactcataaaagtatattttgtttcttttctttttagtctttaagtttaaatacaatttatattatgagtccatattttaaaacaaaatgaatttacatgaaatcctcacttcaaaactttccaatgtttcataactatttattttattttttatactaaacatatttttatgctgaaagataattatgttcaaatcatataacattattatatgcaataaactctttttataaacatgtaacatagttgtatgtcaaaaacttagtatgacttttaagtgttttgagagttttttttattaaaaatatagtgcttttcagtagaaaaactatcaaaacgtaatgaaataaggggtgcatttagtaattttgtgttgatggttggatatttttcgtgtaacagctttatattgatgcttattagaagagagggttaaaattggaagttaaatttcataaagagccccaacggaaattgaagaagcaaaagcatggcatcacttgcttttgagatgaacgtagattggagtcaaactcaagtgaaaaaattgtttttaggggtttccaatcatgtgttcaaactgagttttgtgctctaaaagcatgtttgaggttgccccctgaagaaccaaacatgctcttagtatgtacttgaaactcattttctaacacaagttcatgctgtctctccatgttgaaggcgtacttaagtgaaagtttctttttcttgtttccttttggacatgaatctcattgctccaaacataagcaaacatgtaataaaaattaagattgttggttaaacataaacaatcttactctaattgatgtacgagtttggatataattcttttacttttaaatatattgttttcaaccattatacagaacaacactacctacacatacttatacataccatcttatatttacttaatatctgacccttacttaattttacggatttttttagtgaatatgtataatttgaaattaatttaaaatagattatatttttaactgattaaattaaaaaaataattatatattttaagcataatttaggaagtttatgcatgtttagggtttccacttttgtcttcttggttttcccattttcttttctgtctcttgttacaacaaaaaaacgtttagggaatttttgtaaaaggaatatttacctagattcatttttttaaaaagtttttaaaataagtaattattttaaaattaaattaaatgtaatttatttaaaatttaattaatatatttgtttgttattacaaatacaaattttaagaaaatgtattctaggaaagaaattcaattttggaaatacttaaaaaattacatttatttctttttaaagagatgaataaagatttaaacctttgcctccctctgacaaattttttttgttgaagttattttattttttgaaacaggttaaaagaaatataaatataattgcccttttattttactctcatatgcgacgagttttttctgtatctaaagtttattctgttgaataaagtacgatattgatagaggcaagtgcagtcatgtgtgaaaagtatttttctttttacgtacccatcaaatcgttctttcatttgaaaataatcaaaatatgtcactcgagtcttgaccactgaaatgcatctcgtgagcagctttcatagccacacaggacttccatgcgggaaacaactatccataataataatatatctatctatctatattttttaaccatgttattcacattttttttaattataaagatcaaattcaattttcatctaaaaatatagtgtgctcagttttaatccaactataaattcaaataaaacatctcttcaaatttttatcaaaattcatattttgatgtaagttgtgggctatactggatcagataaaataaaacttatattcaattcaaatttttaaaaaacgagacccaaaatagtgaagaaatttttataattgttgtgggtctcatccaaaaacatctcttcgctattgtgataagaaatatacaaaaaattgtctcgttctgtgcgttgctctttttctacgaccacatgtagacaaaacaaaaaaagaggataatttgtcactcttgtcaccacaaattattttattaatattttttgttctctttataaaaccaaataataataataataataagagtatttatttttatctatttctcttatttattcttctgatttattctttttcattttttcccccaacccaacacaccattaaagatcaatctattacattaatcgagatcaagttagatatgacttaggtgaaatgtaaatgtgactacatggagtcaaaccaaaaagtctaccctgattcaacgtttgcaaaataatgtcaaagttttgtgaaataccaatttgcataagttttttttaggttaagcccaaatggttccatgatcatattaggctaaaaaaattaaatttattttgtgctcaagattaaagttcaaggctacaattcattgagtgtgcttcgagttaagtcgtttacatacttgatctggatcataatttataacaagttgagttaaaaagtcaaaatttaaattagatttctaaaatgagatcaaaacacactagaaacttatgttattcagactattgtgacctaaacctaataaaaaaaaagttaaatttaattcataatcaaaatctagagttgaatcttatatttttcaacatgtggattaaggccgagtcaattgtttgagtctattttgtcacctttatgttaaattgaatacttgcaggagatgaagaggtgtgaacgaaagtatcgaagaagatgcgataatattaaaaggttaaaataagattttttaaaaattcattttcactctttttttacccaaatagattttattttcaaatttaaatttgaaaactgaaacacgagcacctacaacagccacaagtaggatattaattgtttatcaaaatgttcttttttttttctaatagaataattataccttttattgaaaatgagattttaaatgaatcttaatctcatcatattttatataaggttccatacatcatatttgattatttttactatgatattaatgtagaatatctacaagttttagtaatgattaatttctattgaagaagtgattgattactatcagtaattttttttaatcatgtttgttattcataaaatttaaattcaagattttatttaagaaaaaaatgaatttaatatgactccaaaacccctctgactagcgaattattgatttacatcatatttgatataagtgatctgaatccaattttattaaggtgaatgtgatattggtataaaaatttattgctacatattaaatacaatatcccagattcccagttgttgtatagtagtgaaaaatcttaagacggttgattggtggtgtagtgttgtgacttgtgagtggtggggagtgtctaaaaagatgcaatgcaaggtgagaactgagaggagaggcaatacggaagaaagaaagaatggtgatgagatcagagggatgaagaaaaaagagcagaagacacggcaagattagattagattctggtgaggtcttaaattcttaatcacatgcggaaacagaacaagaacatcgaagatggagccagccaagccaagcagaaggcacagcacagcacagcagggctggctgggaagctatggcagaatgtgacagtcaaaagcaggaggagagactaggcaccagagagcagtagtagcactgtcagcttctgtctctctcattcatactactactatttttttttttttttcataaacaaataatgaaaaattcttaaaacacttttactaaccagcagtgtcttcaaaatatagttaaagaattaaaatcacagagtatttgttatagaaattacaagagaacacaaaattttatcaataatataattttatgtattttaatcaaaataaaataattctttaacttaatactgattaatatttatcttactgttaatcataaaatgtacgaatcaattagtttaaaattgtctaattagcaatttaaagtaacgtggtgaaagtatgaggcttattaaagttttctctttctttttctttattcttccctactaaaatgacaactaaattattatttgtaaatacgaaataataagatttactttttcctttgtgtattaatataaaattgtcaaatgctttcatatgttcagagtcattttcatattttctacccacaatgataagtttttgtcatatagtgatagtagcatagctaaaacaagaatattggcgtactatgactttctccatgttacgtaaacagcactcttattttgtcatcaatgtatttgtcaatttagtggaagtatatatattttggttggatccgtgtagcacagctaagattttaatacttatgatatcggagtacgtactacaacttctacatggtatatatgttaagaacacactgtttattttgtcacgatgtattcgtcaatttgggactgtttgttataaaattaagtaagattaattttgataaaattaattctaagctactaaaatatattaatttatttaaattataatttcacattaaattttggacttatggtgtttttgaaaacacattaaaaattgcaaaacgttaatccctaacataattaatagttacttttgcatcacttttaatgtgattttgctccgaacatggatctggaaagtggaaccaaacacgtatttagtttttaaaaaaggtatcccattgtaaaattgtaaaagaataaaaaaagaaaaacataatattgttttagttattgctgattagttttttagtttcaactaacaaaacaaataaagatagtactgtttgggttctaaaaagttactatataaactttgtatttaacaataaagtaataattcggagccaaatttatcgtactcctcgttcgaatgacaagagagaaaaaatgacagttacataaattgtttatactattcaattcaatttatgttacagagtgaggtacaccaagtacaatttttacatacacaatgaacattcaaaatcagaacagacaacagaccaacacagatatcttattgcagtccatacacagagagaaggcgaagtcaaatgggtcaaaggtttagagcggtcactgaacctaaaaaagtacgtattcatgattttaattaaacgtacctataattttttaacattatataacatttttaatcataaattaaaaattatacttatactgactattgttgagatgatgattgagtagcatgagatgaattactaggatacatgaattattgtaaatcctagacattatcaattcttacgggtcaaaaattttaaaattatgtaagacacctttgttaaaactttaaaataaatacataaaatacataaaatttgttttgtaaaataaaaaaaaaactatttttaaagtaaaaataatttagacaaatacaataaaaacagaaaataacttattatattaaaataagcatttattttaataataagtttaaacaacctcaccgtataaaaaaaacttacaatattgcatgtttagatacacaattaataaataaaaaattattatatgatatatagaataaataaaggaaataactattaaatttattaatccttcaaaggtttcacaatagacaataagtaaattttataatattagacatatatatatatatattaaaaaatatatttttaattataagtctcagatgagataataaattaaacattcaagcatttaacatatatacacacaaaaaaccttcgttagcgatccaaaaatcaatcgctatataggtagcgaatcggtcgctaattttcttggcattcagagaccgaacattgcagtattctaaaacccaagtcgctatagaaactgatttctgatttactaatacttagtatttcggtcgctaacaaaaatggtccgtcacagagtcttcagttgcttctacattttaatacttgcaattttcatatcagtaaataaatataatttattaatatctaagtgtttattatcttttaataaatattcaatgttaatgatataaaaaactaagtttaataataagttgtgtttctcaagaataaatttattattgaattgtaaaatttaatgattaatttatcattaagttatactaaaaatgtaagtgtcacaccttttacacatttaaagattatattaaattttttattcttttaatgattaaattatcatcaatatatatatccagagaccaaaattattatttacattttttttctttttaagatcaatatattgttcatttcttaaccattctgcattttattaatttctaatcatttttatagctttaatttttttaaattaccttgtgtcgagttataaatttataataatatcttttattttaaagttttaacttgaatgaagttaactattttatataaaggatttaataaaaatatctatatataaatatttaccactattttttcctcatatcttcgctattcctcccctcccttctctcatgaagtgataaactccactttcgtaacatgcatataatatattctcttatgtttttaaaacaactgaatggtttaataagttataaatgaatatcataaatcaattttaaatataatttttttgtcttcaaaattaaatatatttctaacatatgatatatcatgttattctttaatattaaatgaatgtttaacttaattttttacctctttcaatctatcatttttgatatatttagttctaacatgaatttgaatattttttaaattatcaacaattaaaatagcaatatatcataatataaatttctcatcctaaatctaaaatatgatatatatgttataaaaaattatttactactgattttaattataatatcatttatatatttaaaaatatttatttatttaaattttatttatataaaataaatatttattctatgcaatgtacataaatattaatttcaattaaaattagataacggatattcacaatgctccatcattttttttatttgtaagaaaataactagaacggattttatttataactattactttgtttcttgttattgccctcccttacaatcccataaaaatccaatattatccctccctaaaaagcattgtgtttctgttgcacaaaaggggtgcgaattttttgcacaataaaatcattattctattgcataaaggcataacggtttcgtgattccaatgtgcaaaaaattcacatacccttttgtgcagtggaaacatgataatgtaatgcttttcagagagaaaaaaaatatacaataaaatcgtgatttcattgtacaaggagtggttaaaatatgacagttctacgaaagcgtgatttcattgtccaatgaaatcataatttatttttgatttttttcctgaaaaagagaaatgtacattcagagaaaaaaatgtacaatgcgaaatttcgcataataaaatcaagattttgttgtgcatcaacaataccaaaaataacaaaattgtgattctgctatacgaaatttcacaacagaatcatgatttcgtttgaccatgaaaatgaaaacaaaatacttggcaacatgaatgtaaggtggtgtagaaaaagggtagtttgataattgtgcttgtctgaaaggggccaagaacaattttgttgggtcaatagtaacacccaatggcgaatgattgttggaaggggatattggatcaccgaattgggccgtacagaaatgctgttcccttgatagaaatttttttaatatctttgtaacgcttccttaaattccttctcacaatataatttaaattctacttttaacatggcaattcatattatgtttacttataaatagtattatagtaatatttcaatcattttagatcataaaaccttgatggaggctaccttgctctgaggtaagttccatccttgattatgaggacgtcccaaataacagcggaatatagtcttttagtcgctctagtcattatttgcatttttgtttctgccaaccattttagctgaaattttccaaccaaacttggtcacccttgcaagttgcaatatagtactataaaagagcatgcgagtatagtattgttagtacgaaataaagaaacttttattgaattgattaacgaactttacagcgtgattgctcatagcgggccttctcttccgctattatttacaagccactgcccaaaaatatatatcatgaaacacaaaagcctatcttagacgtggaagcaaagctcgataaactctcctgcggtggtaatgagcttcgcagtcaccattaggatttggggtacaagaaattttttggggtggtggtgtggtgtttagatgactgttccactaggaattaaagcatccttgattactgtgacaatcccactttttatgaaatacccatctgtttcccttgcagcttcttggacattgtcactgttaataatctgagaattggaaacaaaccatagattagatttaaaatatcccgtaacatgtcacatgaatgaaaacaaagtatggcaacacagtatgaaaaaaaaattgatatatttagtgagaaagccatttttatcccaatgaagaggaaatccaagtcatacaattgtatatgagtgatcattctcatgatcgagattaaaagttttttgaagatagattattacttaaaatattacatgattttattttattttttaaataaaacgcatgacttatatattttaatcttgatcattcatgataaaatctaagggtcaatatttattattttctcaattgatatgtccacacaaacatataggagacatatcaaatgaaaactattttttactgagaaatcagatctataaatttcaaccatacaactaaatataaatggtcaaaattaaaagttagtgtcacatgatcacttaaaaaaagtcttaattattgtatcattgtgagaaatgagaatatttaaccacaatcatcagataaatttaatgatttagattgcatatttaattacaaatcttacatgatctttaattaaatagaaagaaaatcacacaaattttataattaaatatgcaatcattacttaaattatcaattattgacataaccaacaacttgtcaatgaatgttaacatataaaagagatagtttcttaagtggttttgatactgaattaaaatttgacttcaataaccatcaaccttaactgtgtaggttattgaggtgaaactccaattttgattcacaaaacaataccaaaatcacctaagctactacgcctcacctgttgtcttgggaaaaattggcttagaatgtaaaacaaggaacaaaattgtatataatagaagatgttataaccttgacattttccccaattcgagcattcttgtcgataattgcccttttgatatgagagttcctgcctataccaattggaacactgcctttagcagccagaaacctcttatcagcctccgtctggaacacaacaatcagaaaaccaatgttgcagttagaacttctagtcaaactaaagccaatcgtattaatcttattcacatgcaattgcaaactcacaatcgataaattgaatatctaagtgtttcaaccactttgacatgtgaaactttgttggctattaaaacttggaaaaaactaggtgtaactgagcacaagttatttagccacattattacctcgtaataatctgcccccattaataacgtgtcttcaataattgcaccttctgatatgcaagatcgcagcccaaccacagaatggtgaattttgcagttctatggaacaaagtatggaatacaaggttagtttcctataaataaattattctcattatatttgacatctttgttaagaattgtataaatctcatgtatagagcagatcagtagaatgtgaaggttctgaaatgcttaccttaatcacacatccttcaccaataacactatcagtgacatcagcatcaagcatcttagagggaggcaaatatcgtggttgggtgtagattggagatgaacggtcatagaaactgtaaccaatataccaaaacgcatgaacacataaacatcagaaccacaaaacactatcattgaaatacatgtgtcaatatgatagatatatcaaatagcctatataatttacctgaagtcaggcacaggctttttggtgattcccagatttgcattatagaaagcctcgattgtaccaatgtcttcccagtagccatcatacaagtaagcttgcacctgtgaatgtacacaaacatgccgtacaatattctcaaaaaattgcatgctaaatttaccatgcaagaaaataacaggaaagtttttgtaatattaaataaccggaaggaacacatactctcattccaatagaagtagcaccaggaatcacttcactcccaaagtcatttgcaccaggaaacttctcacggagcaggtctaacatcacatttttgctaacaacatatatacccatgctagcaatataaggcatttcctttgctctctcgtcatcaagacccaaaattgtagtatcaacctagtaaagaaaaatgactggcatttttaagcaattgttcaggtaataatttccagataaataacaacatataatacatcttatacgggcttaccttcatggctttcaactgttctccttttggcttttcagcaaattcaattatacgcccctcttcatcaatcttcatcagaccaaatgcagtggcacgagcttcatccattggcaatgcagccacagtgatatcagcatcagtttccctatgcgcttggataaatttctcgtaatccattcgatacaaatggtcaccagccagaaccaagaattccaaaacattgtgctcttcaaaaagccacaaatactgcctcacggcatctgcagtaccctgcaatgatcacaccaagtttgttaaaacatcaaatcaagggacaacaaaagtcatcatcgcaaggtaccaaaatttagagtcaaggcagtgctgtcattacctggaaccaattaggattctcaggactctgctgagcagcaagaacctcaacaaatccctcatttttgtagccacccatgttgcttgcataagcacgagaaaggtgtcggtttaacgacgcagaattgaattgagtgagaacatagatcttgttgacattgctattcaagcagttgctaacaggaatatcaattagcctatagttagctccaagaggaacagctggctttgccctcttcttggtgagtggataaagccgagtcccagcaccacctccaagtataatgccaagcacactctataaaaattttaaattgcaatcagaatcagaaccagaaccaatccacatccaattcaaatatcacacgatcgaaattcaaactattgtgatctaaaaaaaaccctgtttacaatttgatccacaaatacaccctaataaacatatgattggggatttgaaatttctcagtaatttaatgttgtaacaatggaacaaatacagagacaaaaaaatgaagaaaggaggtaaacgtactctgctggcatcgggatcaaggcacgtttgtgagttttgggaatcagaaactgctttaggagtaacaatcactggattgcgacctctttttggtgccaatgaaactgaatctgtgggaatcttgtctccacaaagttgtgatgcagagaatgaaaggcggcgtggaacgctttttcttcccacatacgatgaaggggaagaagcagaacgtggaacattcagagaacctatagccgccatagatgccattactctgtgtgtgtgtgtgtgtgttgtgacttgttacttgtgagtgtctcagttgaaagaaacaaataagtgagtgtgtggttcagaattggtgtgtgacactgttaatatgcaaatggtgttagctattattatgagccgtatagtgtagatactattacataccttggttgatgattttttttaatttatttataaaaaaatctgtcgttgggggggaaaaaagtaaaaaacgacaaagcacattttcgtaggatagagatggaaaattggaaatgcaatgcaagtggaaggaacgaattataggtggtaagaccgaggggaagggatttcacagtttgaaccgttcttttattcgaaggagatgaaagggacaggctggcagggtgggtaatttcatgcttcaatgagcaccgttcagaatcttgcttgcctcacctctcatccccatgcatttgtcttggtctattctaaatctagttctaggagtaatattctaggtatatatcattctcaatttttaagattttcttctttcttggcttaatccatttcttttccaaccaacttaacttaattagggtacttgattattttattggatctcgagattctcatgagcttcgaactggttattataatattaatttttagttttaaacttccttatatttaaagttttttcctcttcctcaaaattgtatttttcaaaaattaaatctagatcttctttaacaaattcaatttgtgtttgtcaattcagctacattcattggttgggttaaaccaatttaatactactagaatatgccaataaataaatatacgtgggtagctacagtttactaagtaaaaccaattaaaatggggttgcttgcacttgaaaaggctcggtaattatatactgttttattttatttttcctcgttataagacaatgataaaaatgctggaccgactttgctacaaataaaagatacttcaaaatctcttttcataatcttttaattaaaatgaatttcgtattgctagaaattaatagaagaaaatgacataaaacaaacgcctcaaagttcagggcatctatttaactgatgctggatgagtggatgagtttgttgtattataattatccttagttttcttgtactttttcttaaaaaagtttcgtatgtagagtgaaacatgcagtgactaggttgcgttctcattttccacgggagcaattgtatgccacataggtatgacggcttcaatgaaaggaatggacctctctcacatacacgagctcaagcacggacttgaggggactagtgaaatttctcatttattttttctttttggtatttcgggtgttatgggtttggaactttggattggcaattcaatttgctttgctttctttaaaggccaccaatcatagtagggtggtaattattaaaaatgggtgccaaatttctttataaggtatcttgctcgtgaatgccatctgtgcattgattaaatcctttctttcaatacaattccatgttcaattcacctctgtagcgcctctagatggacgatttcatgaagttttcaagttaagggttggtcatcaattgtatgatacgaaaatcgttattatcgaacttttggaagcagaatggaggcatagctaacaaggggtgaaaacaatgacttctagtgaatctgtgatgctaagcttgagtctaactttatatcaattttctgacctaaaggagtagtttcacaaaagatatcattattagttttcttaaaaaattagaagaatgcgggacatattttcttactaaactgtgtaaattaagtttggtgaaagtttttatgtcaaaaaagtttcgtgaaagtattctcttgaatcagtgttcaatttgtaatgcttaagtacctaactcaaatagtccaatattactattgcatttcaaagggaaaagggttacgtatgggaaaagatgggcaataacaaggcccatgtatatttcattttattttataaaaaagatttttttttttttaactcaggaatatccttagtctaaaagtaaaagattaatccattaaaatattaagatagaacttcattaaataaacagtgagatttactaaaaattataatttctaatatttttcagttaaaaatagagaaaatgttagagataaaaactattaaagagagtgttgttaacatttttttatacaattgttattattagttaatttagtgtagcagtaactaagatgtatttttctttatgcattagtgaggtccctaattgattttttttacttatattaattttaaaaaggctccacctcagatttccttttaggcttggattaacttatcaaaataggagttgaggcaaccactttagttaatgaccaatatctaatatccaatagttgagaacttatacttgatacttaataactgacgattgatgacgggttatcgttgatttttgacggttagccgttgacgattgatagcttacggttaatagcaaacttagaattgttagaacaaagttaggatccattaaaattaggttagtgattcaatcaagtgttcaagaggcgcaaattgtttgaacgcacgtggaaagcaacaacatgacatggtcaaatcattcaaatgcacttcccaaaaaaatagaagtaggcattgaaagataactactactttttttcacatggatgggtaataagaagaaaacattagcgaaaaatgtttaaaaaaatgaaatgttttaaaaaaacattgggtaataataagaagataactaatattttatttatttttattcttttgtaagtttatatatttttatattttgatatatgtaagtatttcaagaattataaaaaaataaattaaaatattatacatatcgaaattttaaaaaaatacgaagttatcgaaattagaaataaacaaatattttactatgtatgagatgcttaattcttagcagaatataagtacatatatgaaaatttaaaaagtccgtatttataaatatcttaatttctaaaaataacaaataagtgcaaacaaagtccgtatttataagcaccaaatcacatgtgaaaagacaggttcttaattgttagattggagcatccattgtttgattagtttagcattattaactcactgaccccactctgtggtccacctcagctgccaccatcttttttcttattcttatgtttcctcttttctctttcgcacaaacgcgtacgtagcaataagcaatgaccagaaaggtgtcgaatttctccgatctaatccaaagggtcaccacctcctgcttcctccacccattcaccaatgacaggtctgacgccgacgacagggaagaggagtaccacagcggctcattaggaaacagacacgaagacgaagatgccagcgaagaaggttacttcggtaaagaaaaaatggtgatggatttgaaggtttcaagagaggaaaagaagttggagaagatgagggcgttaatggaggaggtgttcgaagcggtatcggcaatgaagagtgcgtacgtgagcttgcaggaagcacactgcccgtgggacccgcagagcttgagggaggctgacgtggcagtggtggcacagctgaagaagcttggtctgttgagggacaggttccatgggagtgtgagaagtgttgaagaaggcaagagtagaaggagaggaggagggcatgcaccctacgagacactcatgaaagagctgaagaaggaagtgaaggccaaggatttgcaacttcagaaacttaaagacaaagctcggaggcctcagccttacactaagacaaagcttgcttgcaatactcatattcaaggtaaaacaaattaatacgtcatagttcacttttcaaattaaaaactcagttacttccgatccacttacaaattgacatagctaggcggaaaatgattagatgggtcaattcatacaagacacatatatatagtcgagttttttttatatgtttataataaaaaatttaatacaagtcagttgtgtatcaaatgaagattgacacacacacacatatatatatatatatatactaatatacagagagagagagagagagaggaagggagaatcgtgtaatatttttttatggtgtactttcaataattaatgaagagcaatatactcattttaattagtagagtttcttaagtgatttatattattcttataatttatacaataacacttatttatttatttattatattttatatttttctcttttttttttcttaattgtaaaatttgttatacaatttattgtaaaaaaacatttttcttatgtgtatatatatattagaaaaaaaatgtgtttggttagccagaaaattcaattggtatatatgttaactttcttgttcaacgtctagaaaaaaaagaagaagagcatcttaattataccaattgcaaccttttgacattggtgtcatgaaatagcggcagggtttgtagcagcaccatccccagaactcttggaagcaacaatggcgcaagtaaaggaagcatcaaagtccttcacatctctactcttgtcgctcatgcacgacgcacaatgggacatggctgccgcagttcgttccatggaagcagcttctgccaccaccaccgacaaatactataataataataataatatttgttcagtaaccgccacctccaccacggtctcaactcttcatgccaagtacgcccttgaatcatacatctacaagaaaatgttccaaggattcgatcacgaaagtttctacatggataatagcaccctctcctccctcctcaaccctgctcagtttcgccacgattgcttcagccaatactgccacatgaagtccatggacccttatgagctccttggaggagttttaccaacgtgtaattttgggaaattctgctccaacaagtacctttccattgtgcaccccaagatggaggagtcactgtttggtgatttggagcagcacagtctagtctcagaagggaaccatccaaggactcagttttacaaagagtttttgggggtggcaaagggagtgtggttgcttcatctggttgcgttctcgtttgatcctgcgccaagtaagtttgaggcaagtggtggagctgagttccacccgcgttacatggagagtgtgctgaaatttgctggtgggagggtgcctcctggaaacattgttggtttctcagttagtcctggttttaagcttggaaatggctctgttgtaaaggctagagtttatttgatggctagaaactgaggttatatagagactttaagtgctgtgtttgaaagtcttcaaattaatgtttgcttaattagcaggacttacatgcaaagttgtgatatatactatatcgttttttaattaattcatgtttcttagaaataaatagtttatcaattatttgtagtattattttaaaattatttttcttatttttatctatttaattatttttttattaatgtttgaaaaaaaaataaggaagcaaagatatataaaaaaaataattactacatttaaaaactagaaaaaaatcttataattttttttataaaaaaagtcttagatttcataaccaacgaaggaagtataaccttattgaagtgattattacgatgaggttcattctcgaatatgttatctgacactggagctaatacctttccccgaatataaaagttaaataaattattagttcattatatattagttagccggacattttagtttttgatatgttaaaatctttttgttagttagttttacaatttgtcaaatatatatcattcatttcagtactcattaaatttatgcaaaatgattgtaaaattaattgaaataaatgttttttttcctcacaaaattaagaaccggtgaagaattataaaaatcacattgtagcttgatatatatatatatatatatatttgttgttagctcaaaatgacagtcaaaataatgatgaaaaataatttaaataaatgatttttttactaaatttataaataaacaatgaagaatttttaaaatctcattaattaaaatatttggcctatacaattttagtttaaggatttcctctctcacatgggccaacatatcccatcgcaatcaaacaacggccacccagtgtttcagctataacaaacaatcattacgagttttgttgacaatgtgccccacaacaaacgttggatgaatagaaagctactactaaatattgggcattttaagattcacgacaaacagaatcttttagtcaaactgtgaaattgaaaagttaattaatagatgttttaaaattactattcttttcgcaattcaatgttatcacagaagatcaaactcacaaaacagttaatgatacccttgtttttgttgttgttgttgtgattttctaggaaaaaagtgacatgaattatcaaaagtaaccaaagatgtaattttatgggaaatttcattattgttttcatcgattgttcatctaaagatgggatgggaccattctgcttctataatggatatataattttgaaacagtagatccacttgattcggtcgagaccaagatgaaaagcgaagttactgaagaggtttgctgcaatggtcatataaacgtgttaccgaatggtaattaatatatttagttacttgtcctaaacaaatgaaactatataggattcttattaagctatagtagtggatgtgttttgtgttttgtgtatatgtaatttttgtttttgttttaattatctattttccttagtattttaagtatgttatttgtgaggttttcccattagattgtgattctagattgatagttgatccagaagatgaaaataaaaatgaaataaaggtgtaacgtgcttaggtgggtaataagatgttaagtatttgtatcatttattattgtggtcgtattatcatttatgcaaaaagcttgatagatttgttgaaaataactcatttaaagtgagattgtgataaatatatgctcctgcataataattaaattatgaaattcttaactccattgatttttaattaatggttatcatttaatgtgaacttctcacgttagaggagatgaatcttatttgatattgtacaaatgaagaaagagtgcaaagattgattaaggatggaaggcttttgcaaattagcataatttgaaggttgtccacaaaattatatttgagttcccatatccaaatctaactttgctagctctattgtggattgattaattgtaatttaagtgcttcatactctatcaatctctctaaactttgtttaaaacttttttttagtgaaattttgcaaaaatgatagtactttgattttgtgaacttatgaactaaatatacatcattattttataaaatatattacatattccaatcttattacttttgtttctcatttactaagttttacacaatcataactaaatatataccattatattatatatttaattttgtaacttacccatgcggactgtactaatattaagctataagagtgttttttgcatgatgagacataagtgatggttctaaaatgaatgtcttgatttgtagcatttattattaagggattgtgatcatgatctcgtactttacagttacatgagtcttaacatgtgaaaggaagggttctgaagccatcaaaagcattaatatatggattgtgataagataattgagtttagagtaacgatacctaaatatttcattattttaaatattttttgcagactttttatttttctctttttattatatcataaatcctgttatatatatatatatatatatatatacacacatttttttctcctctctcggtgttaaataacataatgagtgtttatgtaatgttttccttgggtttaatagcattgaataaatgtgtttgctttatttgtttatgggcatctcttcccgcatcccaaaaaaatcacctagccaacacctcctttcattttggaaagggtgttttaacctttgtttatttgagcctaagtggtcataatgaggcccagaagaattttccccaagctaatgtgatggttcaattgacgtttattgttattgagctttaatagggtgggtaaagcccttggcataatctttcaagtttcaataatttctttactgctttgaaagtttcattctttgcaaatgtttagtttatattttttcccgtgcttattgttttcttcaaagctttttaaaaattacttttataattatcttaagaatcattcgaaatttacgagtaaactctcaatttagttcttgaataagataaacatggtcactgtagtccttaaatttactgaaacaagagataatcctctgtaacccatcattcaagtaggtcccctttttaagtctcgtttgttcacataccatcctatgtgacacgtctagtaggaatgtttaaatctaatcaaataagaaaaataaaaaaatcgatccaaaagaaacaaaagccaatgaaacagactatttcattttttttactatttatatttataatagattgatttgaataagtttttggttagtgtttttaaaatcgaatcaatccacacttaattgatatttttaggactcgtgtattttatagcacactaatttaacattttttttgttatcaaataacaaatgacgaccaatgacaaatattgaagggaagggggtagggagtgcgaacgggagagaagagaaacgggtgagagggaatggagggtgtgaagggacataactacacaagtaatataggaaattcaataaaaaaaaaagtgagagtgaagataaaaaaatatcgcattgatacatttaaatcagtttgttactattgtttttaattaaaaatttccattgttatcattgaaaaatatcatgtaatccccaaaaatgaaaagtcctgctagtatttcatagcatcaatttggctgcacaacttaacagggacagagattgaattcacattaactaaacaaaatattcattgattaaaaattagaaaaataatattacaaattccaagacttaagatatacacttgtatgtttccaatcatccttgtcaaatggattgtctattcaataaatattgttaacttgatattatatataagatatcatgttgatgatttattgtccaacttaattacattttttgtttcttatgatattgtagtcgtgaggcattaaaattaaaagtgcaagttatcatgcatgatccaatgcaatgttaacaaaattgtaaaatatttaaataaatgtagtttgttttacaaaactaaatataattagaaggactaaaactgcacaattaagataattgaaagccatatttgtgcaattggaacacaagattaaaatcacatttaggaaatcaaagatacaattaagtaaaaaaaaattgatggtaatgacgggaattgaagtgacagaaaaatcccgcggagtggcctcagaatgttgcactacattaaagtataaataaactcgtcctattgttgcttgaaaatagaaattaacaagaaaggaagaaagaagatggtggaagctcgcatgcaaggttcagtcctaaagaacatggttgaggccataagagagatgaaggtgaacgatacaaacttcaatttctcccagatcggcttctccatgcaagccatagatcccacccgcatggaagtggtggatatcttcctccaatccgatgcattcaagaactactgctgcgaccgcaccatctccatcggcgtcaacctcaacaacatggccaagatcctgcgttccgccgccgacgatgacaccatcaccatcaaagccgactatggcatccacttcgccaacttcatcatcgaaagccctagtacgtttgttttccttctctctcttgttagtttaagatttatgcatttccctttacttgatgaatgaaaagatagaacgtaagctagggctgttctaaagattcgtgtgttgttgttgtgtgttatagcgcgagccaagatatctcattttatgatgaatctggtggatatagacaccaagcccgaatgcgtttttcccgaggagctgatttacgatgcctatgttaagatgccttcagctgagttttcaagaatttgcactgacctctctatttttggggacaccggtaattcgttcctatatatatttttctcttttgcatgcatgcataatgcattactttacgttcatcattttattttgcatgcatgtttctaattcttgctgcttcttcattctttaattaattgactttgcaattaattaattttttcatatgtgttgctgtattttagtttccattatggttaacgaagagagtgtggggtttagcagcaaaggagatattgggacttcaattatagtccgcaggaacaatacttccatccacaaggtaacatgttcactagcaccaaattctttcatgagcgttaacgtaacaataagtaatttgggcttatattactctctgtgagattagaatgtgtgtatttgtttatgcaattaatgcatacaggctgatgaggaagctactgtgatagagattattcagactgtgagcttgaattttggattgacatttttgaactgtttcaccaaggcaacgccgttgtctaatacagtcactatctttatgtcgaaccagctgcatctgcctgttgtggttcattacccgattggtgagaagggttatcttcgcttttgcttgaaccaaattaaaccttaatattaggtgctcttatggattttaaattcggttgtaggaagatattttgtgggttaacgaatatggtactcttttacgttttgtgtagttgcattcctttccctgaccacgttattttgcacattattggatgtatattttgtaaaaatacacaacatgactgtgtttgctggtgttgatgtagcatattgtgtagttaacaggaatcgagctttgatgttgggactgctttactttgtgctttcatgtcctttgtggtaggaaaaagagtatatatgtaaagcacttttcagttttagtttataagtgcttttccacttaccgccaaacagagtaatcataatcataaataatatctaactaatggtacgtttgtttcgtaagaatttggacggatggatggaaagggcaccagattgtcaacttcaagttttagtgttttacaattgttgtcacttttgaattgtgcaaaatagtggaagataaaagaaatctaagtgaaacccacctttaaaaacaaatttctatacttgagcagagaagtggaaaagtaacgttttgtttatacatttatcaaattgcccttattttataatatttttttaagaatatttatatcattttatgttcatgggattttaaggatttttttcatagatattcaaaatcatagtcaaaatttacacgcagaagaatatgtgcaattcacctactgtttcattcattctccttatgtgatgatttataacagtgttaaagaaatcaattactttatagatatgatattatgattgcagtgtgcaggaggggaaaggttagaaactgttaaaaggagaaggttataggaagtatttgagagaaatgaaggagacaatatatgaaagaaaattaatttttattatatgagaaatgtttttgttttgaattagtttacaaatgataatttccttgctttttatatgcttcaagagaaaaatctaaaaatatcaagaaaaaaattcacacacttcaagaaagaattctattcattttttcaaattatttatttatacacacttttttcaattatttattaaatattatttttatttatctctacatttttttaaaattttctttagaatagtaacacaaatttaaataaacctaacacttgattttaatggactaaattaaatttatattattcaacagaaatttgtaccaagcccaactccccaaacgaaattagaaataacacaaaatcacaaagcaatggaaataggggtgtgtgaaataaaaactcacaagccactgggaagcaatggaagtcgagagccaaatctcacatcagagataaagcgaaaaatagataagaaggcacatgcaatagatctgtatttctagtttcttaggacatgtttgtattttattaactttccgttcgcacaaattacaaagtgtgattttaatttgtgagaaataacaatttattatttttgtctgaacgaccgctcaaacattaaaacaaacatatatttaatatttgatattttattttaaataataattgtagtcttattcttttttcctcctaaagcagtgtccaacccgtgtccgaatcacaatttttttttttttaatttgatactgtaattgagtattcgaattactttatcacaacatttgtaaatcaaaattgatcatttaaaaaatatagatactaaattgtcaataaatatataattattttttatgactgttgatattaatgtaaaatatccattaattttatttaagaaaatcgaatccaaaattatttagatcaacaacttattaataattctgaactaaatataaagtatatctaaaacaaataacaaacccacagtgtagtttgttaattattgcaaaggttataaaaactgaccgtgtagtgaagaaataactttaaaaagtataactagtagctcaagggtgatgatattttaataaccttttatttttaacacttgaccaataattttttattttattttatttctttcatcctattacatcgcattatttatcgtatcaatctttctcttgtaagaaaaacttttttcaaaatgaaacttaatgtttgaaacctatatggacttccataaagttcacggttccaaagtgttcgtacaaaaattttaagaatgaagaaaaatgctacacaatagaaggggaggagcgccgaggttgctgatagtgatagctattcaatcccttggtttgcaattacattggtgtgcggttttgattctgaaaacggtgattttaccaatctggctttgccatgcatgttagatgggttgggtaatgggtgtcattactcttcaacaaccacaagataggttgtagataacacgcaactagaacaaaatcattactctctatgatctcacatgaacatatagaaactagaacaaaatcatctatgaacataaatgtcctgatctagttacatccataaagatcgagatgaaagagagaagtgcaatcaacaacattcgtaacataaacatgttttaagtttctgtaaatataattatgtataattctaaatttttttgttactttggtgttccttacattttcttagtaatctattttagtccttaccatttactaaatttaacttaatgctaaaaatgaaaaagtgttggcacatctagtttggtaattaatatttaggatacaaaagctgttcatcggtgaagaaaggacttaaaaaaggtataattattagatgaagttgataatgggatgtaaggtttgcacgtttaccaacttccataaatttcagggtactatctcatggccttctgcactgtgttatgctaagagaacgaaagtagcgagttaatccttattattggagttttttttttttttacaaaatgtatagataatattgggagaaaaaaaattaaaaacattaatgcgaggaaccaaatagcctccctttctctattgctcataacatatcaatttaaattagaaaggcacaagaaagtaataagtatagaataaaagaaaaaaaacaaatgttaacctgcgtctttttgttaagaaattagaaggagaaatctttttttttttttttttttactttaattacttatgatgtttgtctttatcggacaattaagtccaatttaaaaagtaaagaaagcattgtgattctcgcttgctgtgatgaaaaccaaatacaaaaaagtgttgccacgatctagtttggtaattatttcaaaggatacttagtagatcaagttgataatgggacgtaacgtttgcaagtttatcgacttccataaatttcagggtattaatctcttggccttctgcactctgttatgctaaaagagaacaaaaataccgagttaatccttattgaaaaaatattacaaaatgtctagataatattgggagagaaaaaaaatgaaaacattaatgcgaggaaaccaaatagcctccctttctccattgctcatcacatatcaatttaaattataaaggcacacgaaagtaataagtatagaataaataaataaaaaaggtaaaattgataaaatctatctaatgatatgtcaggtctgtaaaaggaggtgcgctggaacataagcaatgcaaagaattggataactataatcaatatcacttgcccggaacaattttaacttcagcattgaattagtgctagtttttatcccctataacaatatagacaaataaacaggccgcactatcttgtacagatcgttgaatactcgttgaaacattctccagagcccaatagcacaaaacgatcaaagttgaagtaatggcaatagaacatcagcagttgatgaatatggtacagggatgaacttcaaccacacgtatcaaacttaaataagaaaagcatatctcaaagaacaatatgaaaaaaaaaaaaaaaaatcattcttattgcctccaatcttcactggcataaactgcttgatctccgagctcctcctcaatccgaagtaactatcaaaattcagatggtaactgttatgcttttccttcgtttcactttataaacgagaatagaatacatacacgacaaatatcaacttcatctctacatgagactcacagctattgcttttaatatgcatgttattattaaaagaatcatatacagatattgccatcaagccacatagggtgagaagcctaaagaggaataacatctacagactcaggtactagtacgactgctattaaaacaagacagaacaaattagcatatttacaaactttaatgaacaaaattacaggttataaaatcatcacttaaacactactgatatcacaaatatacaacctatcatagaaaactgccaccaccttcccatgggagaggaattggtgagttgacaaaataagtttggtaaataattttttttgaagtattcaagaatcatgaccataatgcatgcagtaaaaccatcagcataaaaatcagaaagagacctggttgtacttttctagccgctctcctctgcaaggagcgcctgctttaattacaccagaagcaaggccaacagataaatcagcaatgaaagagtctatagtttctccacatctatgagacgttaccaccccccaatgcgcttcctttgccagcttcaccacttcaatgacctccgtaacagttccaacttggttgacctagattacaatggtaaatcaccacattttcagtgtattttcttcaataaaacagaagaaaaagtacagaggaggatatttaaaataccctcccaaatgatttataaaaataaataaaaagtggcaaaactaaattacaggcaagctatgtttagatttctttttcttttacataaactagctttgtaatttacgatcttgtatttgcatgaaaaagatatttgtggatatccaacacctcaacttagatctgaaacaagattgcttccagtccatgaacaactaagtttactatttattattaaaaaacaataatataaaaaaataaaaacatgataagattaaattttgtcattaggcaaaacagacacttgaaagttaattgaagaaacagcaagttaccttaagaagaagggcattacatgcagactcagttattgctctctcaatgcgttttgcatttgacatcaagagatcatccccaactacctgcagaaccattcaaaatgaagggaaactgtaaaaacagaagttccaatcagtagccaatatataaacttaacatctcggtggtaatatgcaaatgacctttctaacgctcacaaccccaataatgtgacaaaagacaaaacaattttatatgatattgtttttcctcccttgttcacatagcctgctaatgagtcaatatggcattgatacactaacaatcagttggttattattttctattaaaaatatccattgctatcattaaaaaatatcatgtaatctccaaaatgataaggtatacttcatagcatccatctttggctgcacaagttaaccaggacagagattgaattcacattaactcaaacaaaatattaattgattaaaaaataatacctgacaaatcccaagacttgagatatgcttgatatgttcccaatcttccctgtcaaatggatcttctattgacacaatagggtattctacaaattcaaaaagaaaaatccaaaataaagacaaagcataggctaaataatttataatgtcccccatcaggaaaatactaagataaaatggtttaccagagcatagttccttgaacaactctatcatatcctctgctgacttaaaattctgtccagacttttgaggagattggaagtccagatcatatcttttacctatatcagggaaaaagcacatacacaacagtagaaactggttaaaattattcaaaggcaaaaggtgcccaaaaagtacaagggggttttaacagcatgaggtgaggcagggtgcatcacagaaaaaggcgttaggggctgttagcaacttagcattagaaaaagaagaaaccaatcaacagtgaaatattataatattttgcagcaactttccatataaattaattatctagtattaatattaaaaataaaacattaaaatgataaattatgacaataagttgataacaagctctacagattaaagttcataacagtcactcatcatgctcatcctattggcttttaaaaatctaaccctagattcagaaacaaagctgaaatgacacccctaaatagaatataaagatgacatattaccatggccaaggatggtcatttgtatttatagtcattattgaagtactattatcaaataagagtactatttttgtatctcttagaaagactagttttattttgctatgaaagcaaaggataattaatggttcatatttttcataaatgacgcagtaaaacagttagcatagcactgctgcaacaaagactctcattacaatagctataagcaaaatagtagagcaagaatcaccaaattccatcttcttgagaatctaaaagtacacaagcgagagaaacttagaaatacctatgcaaaaatttgtagcagcaacatcaagagctatctttattttctcattataaccagttctgctaatggcctccttcacaagatccagggcttctctaaagctgatgatacttaaacagtcagctaataggtagaagtaaaatcaaaatgcttaatataacaaaagatttctttgagtggaaaaatacttaatgtaacaacattagccaagtgcaaatttcataaatattaagtgattttatattttaaaaactatagtagtttggtattaaatctttagttgcttaaaaatttagataattagcttcaaataacattaacaataagcaaaagcaagtacataaaattaatacaaccaaccctttatattaaatttgataatatattctcttgaaagttaacttaatctattaatctactctctcttcttttcatttacaacccatattctttggaattaattcttcatatcatgcttataacttcatcttagattctagttttatatttcacctgaattttaaaatattcatgcgcataggacactagctggttttattaatctttaaaaaaagatgtaatcataattcataacatgcatttaccatgtagaagaaaacatggtaattataacatgcagcagttcaaaatgttggctaaaagaaagtgcaagttagattaagaggcaaaatacaaatgaaattctttccatcacatatttatcatagatttcaaaggaacagggatatcatatcaatgtatccaagaaatcacaacagacagtaagagaaattacagcagtaaaaccagtagtttggagatattttttgtttttctttcctttcttctaaaatggagacattttaccccttttatattattcatttaacagtgaagaattttacagaaatttgtggtgcagtggttccatgtaattgaccccacaaagtggaaaaaggctttgttattgtatttaacagtaaagaattttcaaaagctgtagaaatccaataaaaagcttgcctggagatattaggagcaaagccaccatcttcaccaacattacagttatgtgcaccatatttttctgtaatgacagcctgcccttttgtcatcaacaataattaaatgtatcagcttaaacacgatatcagcaagtgattattaggattttttaatccatcattgatcaaaaaacatatatatgggctgggaaacaacagattggattgtcaaatcaattaaaaccaaataccaccatcgtaggaacagtaagcaacaacaaaggaagactatagtagtaataacataggatctaccgatctaaatcattgtaagccaggtaaacgacaatgtaaccaaactcaatgcaactaaacttgatatgtttctagtttgggaacattgcaatgagtgaaattatgaggagaaaaaaagtccctaaagacagaaagtaaaagcaataggattggataaaaaaagaagaaataaagcaaaaccacctttaagtgatgataggtctcagtgcccattcgcaatgcttcctcaaatttgcttgctccaattgggagaatcatgatttcctaataggaattatgtaagaaagatttcataattaaaagagtctaaataactatgaagcagaagaaacacagattaaaaagaaactatatctgtttatgtttgctcaaaaaataaagaacagaatcaaacacaacaataaattgccaaagttatgccataaataattgaacaggtgttagttacaacaaaaataattgaacattagtcatttaatttcactgttcattagtttctttggaggaaaggaacacatccctaatggaggtaagattatgaaaacacaaatgagaatgtctaagaaattaaacttcaacagaaattatacctgaatggccagattactcccagcatgttttccaccacttatgacagtaaaggcaggaacaggaagtgttgggctggtttttccagacaggtcagcaatatgcttgtaaagtggaacctgtatgtttttgtctttattttcatgatatcatgactgaacatatatactaattttccagattaaaagttaaacaaacttataaaaatattaattgttagagagtcatgcctccttttctgcagcaccagctttacaagcagcaatggacacagctaatatagcattggctccaagttccccctgcagagaaaatcagaaacagaacagataatatatatatatatatataatcttacaaaaattgggagacctatattgctaagatgaattattcaacaagcatgcactagtatctgatcgcaacaagtgtatgatataagaatcaatgacacacactgccttcatcaagcaaccattcaaaactgaaaaggaaactaagtatgcacatactaagtgaagtgcaaataatgcttccaaaatatcttgtatgaatttatcatatttccaacagccaaacaaattctcctactagcctaagggagcactttgtaaaagaaatggaaaatgaagagagagaaaatagaaaagtgaaaatatatggagatgcagaaggaaaactacgaccttcaccacttagagttgtttccgaatagcaacctagcaagcactatcccaattgtatccatcacataactaagaaaaactaaaagttatgtatcctggactaatgaaaaagacagtaaaaccatactattaagactattaaaccttttcatagcatttttcctaatcactaaccaaattcattttgaaatgtaaaataatcaaagcatagaacacaacaatatgtaatacggtaaatcaacagccaattgattgaattcatagcagagagagcgagacgttaaattaccttcttctcagttttgtcaaggtcaatcatggcctgatcaatctgcgactgaagcgtaggatccataccaatcaacgcctcagatattttgtcattgatatttttaacagctttagccacgccatttccgagatacactcctttgtcgccgtcgcgtaactcaacagcttcatacctgaatcgaatcaataacaaaccaaatcgataattgaacgagagcgattgataaataaataataataataaaaggcttacatgctggtggagttgccgctgggaacggaagcgcggaacacgcctttgttagtgtgcaaatcgacttcgacggttggaattcctctgctatcgaggatctgcctcgccttaattttcgttatgaccgattgcactgcttttctcatgtgattcgactgcggtcaccgaaaaaacgcatgctgagaaattccgatgagagaaacgggaaaaaaatgaaaagagatgatgagaggtagagagatacgatgaagagaacgggatcggaggttttggccctaacggcggcattgacggcatcttcgagttttcgggaaagcatgtgcttgtccaggtaatcttgcactgacatctccacaatcagctgcgtcttcttctactctccaaattctcactcacagctgagaagatgtgcgtgcccttgctttcttcttctgctgggaaaacgagattcaacactgatgctgctgcttcgtcttcctagtgtggcagagactagaaaaccgttcttgttaaacgtcgtcgtatcattgtataaacaaatcgagtttacttttaaattttgtttatttcctttattccactaaaatataattcaaatggcaaaaaattaaaaataatacaattaaataaaataatttggcaaatggtgcaaatggaaaaatatttgggaatctggggtactcaaacacgcccaaaatagggcgggtttaacccgccctattttgggcgtgtttcaccagatgttgacacgtggtagtcatgcagacggggtatggtgtgatcgcaaatttcggaaggtcataacttttgactgggatgtccgattgagacaaaatcggtggccacgcgctcgaaattgagagaagaagccctggtcaattcctaaagtgaacttgcccaaaaaattttcccaaaagaggcctctaagtgcctcaaaattgcgatttaattgttgaagctacaaaaaatttcgtgttttctaattttttatctattcaattagtgaattgcaatctattatttatttatctaactatttctcttaatttcgagcattctaacataaaatacgtcatcatcggacattgctacgagaaattacaactgttcaaagttatatgcatcgtcgatattatagtctaattttgttcaattttttaaattatttttgcgaccacaacaacatattttttaggatttatggtttagggtttcgggtttaggatttaggacttagggcttatgctttagggtttagtggtttagtgtttagggttaattaatccaaagccctaaaccactaaaccctaaaccactaaacccgaaaccattaaaaatctacagtaagaaccttgacatacattgtttcaacttatgccaagtccatcatcatatacataaagaagaagcaaaacagaaccatcaatagttaatcattaacccaaagccctaaacccctaacactaaaaccattaacactaaccaattatccaaacacactatctcttagccctaaacacataaaccttatccctctaaaccattaacctaatccaacagttaatcattacccaaagccctaaacccctaaaccgaacccactaaaccctaaacaattaaccaaatccaacagttaattaacccacaaccctaaacaaatgcataaatttccaaaattatactgtaaaatggatgatgcatataactttgaacagtcgtaatttctcgtaacaatgtccgatgatgacgtattttatgtcagaatgctcaaaattaaaagaagtaattagataaataaagaatagattgcaattcactaattgaatagataaaaaaattagaaaataggaaattttttgtagcttcgacaattaaatcgcaattttgaggcacttagaggcctcttttgggaaaaaatttgggcaagttcactttgggaattgcctagggcttctcctctcaatttcgagcgcgtggccaccgattttgtctcaatcggacatcccagtcaaaagttatggccttccgaagtttgcgatcacaccgtaccccgtctgcatggctgccacgtgtcaacatctggtgaaacacgcccaaaatagggcgggtttaaacccgccctattttgggcgtgtttgagtaccccagattcccaattattttcccatttgcaccatttctcaaatttttttatttaattgtattatttgtaattttttgcctaattcaaatatataaagaataaattgtgatatataaaaagttagtttacatttataataattaccttcaaattatatctactcgtcatggtttttaattgatttcaatataaaaaactttaagctaataaagtatagaaattaaactctacctttaataaggataattctaaatattatgctgttaaaaaaaattgatactaaaagcctttaaaaaaaacacaaaagtgcatcatttttcacaaaattaaccgatttataatatgaaaacttgtttagttcaagaccattatgtggtagcgatcttaagcaatttccatatggtgtataattgagtttttttagtttacaccaaaaaaaataataaaattcaattatatgtgtcgcgtgaagtttgaccaagatcatgacggtccgaaattatataataactactaaaaaagatgagtttaagaactccttataaaaaactttcatgtatcaccaattaaagatgggagtgattaacaatgttataagagcaattgtaagccacaaatgactaactactctgatcaattattatgttcacccaaatggaaatataaggaaattggctagttgcagagaatttctaggagaggagaaaaagaatagtgaataacaaatgatatccggtggaatcatccttgatttaatttagtgtattgtgccacagtttagtacaataaaccacaatatagtagaaacagtgttcgaaccattaaacatgtataatcaatcagtatgcccccctttactatgcaactacaaatgcactagatgaacctgtaaagtgatgaattgaacctaacaagcccttggcagccccaaaatgtttgattctgtatacaccaggagttacatcctgtgggattctccattctatggtagctttactttgagaactgagtttgaaaggcctagaccacttgaagcgcaggcagaaatcatcatcatcaaaagcaggaacccaagtatcctttccttggagaaattccaccagggaaaatgtaccttcagtcataaggtcattgcgagggcacgcagaccagaaagtaacagacaccatgtcacctctcttaaaggttgagttcttgggaacatcagagctacaatccccaaactttacaccaataggggttgcatccatcacaaccggtgttaataagcttatttgcttatcaaggaggtcagggggttgtggacctggttctacaggctggccactgatgagagcacgcgcaagcttcgtaaactcctgaatgtaagcactcagtgtgtgtggaccgtacagcgtggacgcaccctggtaacatgaaaattgaagttaaataaagcagcatataatggttacatctcttgccaatatgaagttatgttatttgatgataagttgcatccctaaaaatgtaaatttccactaatgttgcatttactcttgctatagcaatctaaaaaggtttgctgcatgcttcatgtctctttccacaagagttgtaactgacctcatatctctgcacctggtactcttcgtatgtggtcacatactgtgaataactattagtcaaccccgcaataacaacatgaatgttgctaccaaagcctttgctaccacttagcactgtcttcactgcatcacgaagacgcctcccagccattgttgtaaattctgtcagaagtaaaacaattacaggaagcatgaagcacccaaagaaatacataggccagattagattgtctcacaattcacaaatactggtataaaaatataaatatagatctgcaaggaaaaaaaaaccatatataatataatagcacaacatattaagcaacacatttggattttggattatatcggatcttaaaacatttagacacacaaaaataaatagtgagagactcgcataactaagatgcagccatcctttggattgaacccagtattgctggaatagacatcatcaaaatatcatgatcccaataacggttcaacatttttttttcttctttgactcaatatattctcattcgaccaaggttgttgatgttgaaacttaaatgtttcaaaatgcaaaggatagaaattccaacaataacatcattttaagaaattaaaaataagagctcatacctcctggtacactgagaataacaagctgcccaactcggaggatctggataggaagtattgaaggctgcaattgaacatgagcaaataaaggttcaaattagtaaaagttatcaaaaatcagactctttgtttcagcagggagagcatttccaatcagggccaaatgaagaaatatttcctttgaaaaaagatgccttgtgatggtagcatatctttatggcagaaatgggtgaagagaaacatgaaactaccatcatcaaagaacatcaaatgagtaacttactgcccaatcatatggtaacttcatttcgccagtatcaagcaaaatgggctttgggcggtgacagtctatttgttccttgcctggcgttttaagtaagttacggaccagcttccagaaaggatttccctgacatacaattagaaataataatcatagagtttcaaagatatttaagaatacaaggccaggataataggtaagcataaggtcttatcagtggttacctgatcatcaccttgcttaaagtcaaaagctccaggtccatctgttgttccagcagcaaatgcaaatcccattgcagcagggcatgtctttacaacctcagaagctcctactttagaaggatttacctcaagctgggagaaatctatgaaagcatgtcgaaaatcaaccttccctttaatctgttcagatgctccgttgaatagctccactgcttttttaaattgtctctcccctataatacgtgtgctttcaaattcatctggataactgcaacatcagtttataggagacactttagcaaccataaaggattaggaaaattgtagaaaaacaaagaaacattgagcatgcaataaaaattacccaggtcctcggccatagcataattcattctttcctccacatgtactatgattgaagtcacaaggtagtccagtgtctatacaaaaagctccgagtacatttggactaacatcaccgcaatttgtttgacaaaatgcagaaacaaatctaggcttgtcaacctgcctaaggacacctctcacacgtctagcaacgcttgaagttttggttgcaggtttaccaggaggagattggaatgaggcagcaagttccagtaattcatggtctggaccaataaatttaagtggggttagaaacgtattcatttattaattattattatcatcatcatatattcacctaattgataaactatttatgccacatatataaagcaagatatcattcatgtatgtttcattagttttctcaatcagtcatttagggtatttacatcttgtcttgttcgtagacaactccattaactccaccaatattaggacttatatgagaagacttgtaaaactcagaagcaccggatcagagctcagaatacatgtaactaactacaagaggcaatccagcacgttgccaaagtacaaattttcctcttgttgtttggtgattgctctttctctttggactgttttaaggcttgttgattttctacagcaactatttctctgtaaggataatctaatatattctaaaatatgattagaaatttttatacattctaatttctaacacaaaaggggggaaatcctttggtcaaaccacatttgaagcctttaccctgcaaggcaaaaacattctagaacagtggacccacatcacgtggcatataaacctataaattctgaagctatgtaatgaacatactgtaatggaaaagaagctacttagtttatcaatggatgcattgtagccaaaagcaaacatcttacgattatcatgaaggctgggaattatgtttgaaattcttcgggggattccatcattttcaaatccaaccgaatctattcttacagacccttttcgctcaaaccagtcttccataaatcgtgcagctgcacccttattatccccgctaattaatgagtttgttcggctcattgaagtaccatgagtagcaaaccaattgaaacttcccaaaggaccccattcatcatcaacaaactttaacagagtcatttctttatcaacatcatacttaaatttgcttctctctgcagcaggattgttgagataagcactaggactgcgatttacaccagcatctaagagctctcctgcaagttgaagataatttatctcaaaccatgcgatataatcaacaaagagagggagaaatgacataatagttaaaccatatgactaccaactagtgcacttactagaaatcacattgatagcttcaaaataatactactaaacaaattcttaatacagttaatgatgtcaggaaaagtaaagatgggaaaaccctacatcctataagaaaaagctcaggcttgcctcattcatttatttctagacagttggtgcaacttgcttcttgcagtttttcatctttttctgacatgcttcaacagtatgcaaaactaccataattataataatttacacataacatttaaattatccacctgtgctcacatctgtatacaaatataagtacccaagggagaaaggacaaagaaggaatgacaagtctttcccttacccttattgacaaatattgatcctgggcggagattttcatgggcctgaacaatggttttctcaatgccatcaacaatgacatcaaatgactggcgaacaaatccaagagatgtcacaatatacacaacatactggagataacccccaggaccagcatgagtgtgaattccactaatagccacattcttttcagtatataggtcaccatatctgtcaaacaaaataaagtacaaaatcaggcacaaaacttagggatcaaacaaattaaatggaaacatcagccgcttttcacgctagagaacacaatcgccggagaatcctaaagctcaatatgaactcaagaaaccctggtgagactctaccaatcataccctagtgtgacctgggttagtcatgcctatataacaagtgtgtcctcccacggttcctgcttttttttctggagggtggagtgaatggtgccttagtcacgcgtgaggaggatctagacctttattatattcggccttaagatctgagaggtccgttgactccgaaagccttaggacccctccatagtaaatgctcggacttactagtgtaggtcagccatctgtgacctacttactcggccgaatggtccatagtccctcaagcttctagcctgaaaggcataggcagttatttggtcaactatgcctcggcagcttattcggtcgggtggtccagctgccactcacagaaatataagaaaatctcccatataattaatcttccataatttctacaagttattatcataatagttatttcttgagagcaaagaagtcattattgataccttgctttcagcctctcaattactttgatgactacaagctgtgaagccatgcaagcgtcgaggttcacaaacactacccggttaccctttggctgagcaacaatgaaagcccgagcccgcagcctgaagtgaaccccagatgcaatttgctcagtgttggcataccccatcatgttaacatcagctgcaggaccggtaatgtcatagcttcccataccaatcaaggaatcagaagccgattgcacaacatcactcttcagaagtagcaggaacaagaaaagggtccaaactcgcatagtaggggaagggaactccatgacacccaaattcagagaaaaaacaagaccagttttctttttttaaaaactcggccagttcttctcatctcccttcacaaatcacacccacaaaacttgcagttattacaaaaaaacgaacaacaaaatagaaatgaaagaacttccaaagcaagcaattccaaatttgcaatcagtcatagctagaatataaaaaaatatggttcaacatagaaaagcgtaggaagcaataaagggcaatttagtttctcaccactcagatgaaaagctgggaatgatgacatgagcatgtcgaagtaatctaagttatctgtggattgcagagaggctgccccaataaatgaaaagggaagaaaagccaattgagagagagagagagagagagagagagaagaggcagtgtccaacggagagaaaggaaaggaaattggactggttggtagagacgtagagtggaggaactggcacgggaagacacggacgtgcagtaaggggtcatccaccctcctatttgaaggttcctactttggattgcatggaaaataatttttttcatgctatatgaacttcattcgtctgaaagtgtgacaaatttgtgtgggagatattgaacacatacacaaattatatatttttctcttaatataatttatttttaatcaaagatcaataagaattcaaataaatattaatcatttaattaaaagatataaatcattaacacttacttatgtgtgctgttttggttaatattataaatattactgatatagagtaatatgtaaaaggaaaaaaaactaataatatacattagtttatttttctttataataactatatatcaaaaatgaaaactattatgcatgcttattaaactctttcaaaatcaccacttatcaattttgagctaagtaatacaaaattgttaaataaacaatagtttacattattttcttattttattgtttaagataatgtacatatattaagaaattaatttattatattaattttataataaaataattctatctaattaaaacaccattatttcttaaattattaaattccttatataattgtagttatacttttactagtctatttattttttaagagtgttatgaagaatgtgtccaccttaaaccttaagtcattagtgttacttgcatcaaagtaacactaacttgaagataattgttatgagaattatttcaaccatactattttagatggcatgtgaaataaatgagcacaattataagttgactaaataataaatttaaaaaatatttaggcatgtgactacacttgcgctaaagatgtctatatataaatatatccttgcacaaataagagtattcactccttttcatttattttcctgcaagtatttctgacttgattattagagtccatgtgggagaaatcaccttagatgtgaaaccttcacaaagattccagctctatcctgcatcacaacaaagtgttattataaaacaaataattaatatattttttaaaaaagtgataaataaaaataaaatgagatagatatattaatgaatttgacacactatatgaacacaagtagatctaaattaagtggatcacatatttgcagttagcctataagtaaacgaaagtgttgaaaatttgagggataagaatcatgttcacatgggctaaaaataatgctttgaagtaggcgcagaaaattagtgggaactggtatgatgaattattttgactaaatattgttgccagttgccacatggagtaatggagacatggagttcgatcttggatcttgaagttcctaatattaattctgtctccacttatctgggtttctttttttatctttctccattgaatgggatcaacaactttctataatgatataaaggaaaataaaatatgtttacggttcatgtgatcgattgataataatgcgttggatatagtagctagacatttaataccaaatatgtttttttagaatttaatcaagataacttcggtattttttaattgtgagtgtaaattgtgtagtaggagataaccttttttatctttcaaaagtactattctcattggtggaggcaaaattaaagtttgtgtagttatatttcattaaataaaacaacacttaggtgttcgaacttaaataacgataaaaattgaaagagaccataagaaaattcttcccgaatcaattagtaagcttgtgatatgtggacagattcattggtttgaatctgaatgtgaatcaacaaagtatatgttggagaaataaacgctttataaataaagctcaaaagaaaaaatgatgaaatacttcgaagttttcttactctgttttaagtctaaaatattttatgtttctttggaagtaattttaaaaataattaaatatatttaatttttttagttcaaatatttgagacattggatagtatttttttttcaaaattgttttatgcaaacagtgttcatgtattcaatgttttgatacatcaaacaaatataaaaattattcaatatttatttaaaaataattaacaatattttctaaatatatttaatattatttaattaatattttaaagaaatttgttaaagatattttcttaagatatgtactccatactttaggcaatcaggaatgacagattctggccttggaaaacattccaacggatgcgtggaagtcaaggcattcacacaacacttggagagatccaaacaaaatccaaatatgctccattaagagtaaactagaaggatcatcgaagctgtcgtggcccatttcctttaactttttcattatattttcttttgtccttttcgaagaagaaacaacttcttttcacattcaaaattcaatagtggactccaatcataggataacattaaatatatacaccagcactaaattctttcatgtgcgttacaaaatatctataaacacgcgaaattgataaaaaaaaaaaacccaaaactgcttaaactgaaaattacaaaaaaaaaaaaataaaaaccgtatacttttagtggcttggtttgattttttgatcttgtcattaaaatctaaccaaataacacattacaattatattatttcattgaatggatgtttaatattatgtagacagtttttcaattttaattattatagtatgttatttatagtgtatttttttctataataagtttataatatatatatatatatttatcataataattaataataagaattaaataatttatgatatttctttttgttttgtaatcaagatacatatattattttcatatgttaaaaaaagaaattctaatattatttaaaattagtattaaatatcaactgatgtaaaatttattattatgttatgaaaagagttatttttaactaaaatatgtttttcaaaattaataaaaaaatattttcaaataataaaacataataataactatgtaagtttgatcaataaaatttagattgtgataataacttaaaaatataaaaaattgtcaaattaaactataaaagatttgttttacttaattcagatttaatgatatatctaaatcaaatcgcatctttttattttatatttatttttgattattgaaagtaaacggcacccgaaacacgttactgtcaacgcctcagaattaactaaaagaagaatttagcgaaaattaaaaacctataaaaaagagtatagaagtggaaagtgaaagagagggcgccagttttcaaatactacaatggggtccagcttgaacaacactagtccaatctctctaagtctctattatccgttccgttcataaatttaaaacttcgcactttcttcttcttcttcttttcttttttctttttttataaaggacgcacttactcgtactcttacccctgttttttctcctctcgtaagaaacaattaaaaataaataaattcgccttctcgtcggcatcgtaattgtggaactagaaggttgttgcgccttctcctccgccgtgcatgagcttcctccgccgccaccatgccggcaaggcgtccctcctccgatctgatcctccaccgtctcgcctcgtccgactgcgaaatcaagctcaaagccattcgtgaggtcaagaaccagatcatcggcaaccgcaccaagaagctctcctatatcaagctcggcgccgtccccgccatcgccgccgctctcgctcaagctgacgccgattccgcctccggctccacccccatcgtccagtccgccgccgcactcggcagctttgcatacggcgtcgacgccgctgtccgcgctgtcctcgacgccggagcattccctcatttaatcaggctcctctctgccgctgacgacaaggtcaattcgattaattacagcgtttttttctttttgaaatttcttttgcgtgtttggtttctctgacattggtgctaagatgaaattgcaattgtaagaagaaatcaggaagcactgcttatattgcattgttgctcatgttgataaattggaaattaggaattgaatagctcgcgtgaaaatagctatgtgcttgtctcataatcaacaacagtttgtagagtgtacgcatgctagattgttaagttgcgagttgttgatgtattctatttctctccttttcttgctaggtttattacagctaaaactatatatatttctttcttagtgatgaacgcggtacactgattagagatagaaagggatagaaaaatggagcggtagagtgtttgcgaaattcatctataggtagagaaattggaagggccaaaacttggatggtacaattggaaataaagaggagtccaatggttaatctcccggtaacttatgttttactaccgttacatgaagcatttttttttttttttggaacaaggagactctctaagggcagaacttttggctatagagcatggtctggaagtctgttggaatcttggctattacagtgtggtgtgcaaaacagactgcaggaatgcagctgaagaatctatggaagagtgaatagattggcatgtgcatggggatgtaatttgtcggattcaggatttcattgggaggggctggaatgtctcactcaatgtggtgtctcgagacattaattgtgttaccgatttgttggcttggtggggtacaaataataggtgtgcgacgcatgagtggaagctgccacctgtctttttctcgttgcgttaggcactgattctttgtctctagtttagttcctttgtatttctttccgtacatgtaccaaataaaattatgattttgtttggctgcttgcagtgggcatttttgctgttgacaattcattttgaatttctttttaagaaatttttttggtaaggataacagaagttttacccgctcttcttgcatgcctatctctttacctgcctacaaatacaagcaaatatacattgatttgcacttcttcctttagttttcacctatggtaaaatcatccttgatttgaagaaatgtatgttggcttctaattaccagatgtgttgaagagtccccttgatttgtagacacaacctcttcatgaaatatcaaaaagccaattaatttatgataaacagcagttgtgaggggaaaataaatgtattatgatctaatgcttctataatctttatgaattggctgtaacggtgtgtaggcattcattctagttcaatgcagtcagtggggtgtggacatgatttaccaagtattgtcactttgtatatcttatatctattccgttttaagctatttgctttcatattttagtgctaggatgaatggacagaggttacaggaagtgcatttgttattgtttctatttgatctttaaatgttgaatatttttcaagacttctttatgccttttattcatttgtggcatgtagtaggtagaacaaacataccagtccttaacccttatacattaattatcattgtgataagtatgtgatatgactgtattttttttccaaatgtcatctaatagacctgcctccccttgatttcaggttgtggatgccgctgcatgctctttatgaatgatttatcgatcaaaactagctccaaagtatgacttttttaaagaacaagacatgcaatttcttctttcactattgaaaagtgggaatgaaaatcttactggactaggtgcaagcattgttattcattcttctgagaaaagagatgaacaaaatatgttatgctgtgctggtactttagtttagaaacacttattagccttcttgatggttctctaagccagcgagattctagtttagaatcccttactgcaattcttaaaaacaatccagaagttgtctctaaatttgtggaccttcaaaatggaagagctttgagttcggtaattgaactaaccaaggacaggtattcttggactaggttactagcctgcttgtgcctgattagtgtaaagaattcatcttcttgctatctgcaagacataggaatcaaagccaaattggtacatattttacttgagttccttgatgattctggtcaagttggagacaatgcttcctttgccttttcaagtttagttgcagaaaaagaagatttgcagaagttagcatttgaggtacatgctattgataagttcaacagtcacttgcaaaactgtgctttacatcccaaacaacttgaagggatatttctaaccttagcagattgtaaaacttttgaaacagtcattggtggaatacaggcattacaatgtacattggtatcaatgttccaacttaatgatacatattatgattatgttatggtcctcctttttatatctccttcctccctccctctattttgggttgttatacaataggaggtgcaagcacttgggttggggagaagggaaaggtttcatcaaatgtttttattatgttgtctcatgattttatgctagtgttctgtcagagcatagttagtactgtatggaaaagctgttttacccatatggcagaacagcatggtgaattttttaccaactgtcataataggcaatttttgaagggaggcccactgtggcagtgctataggccgcaattgtgtgtttgtatggcggatttttggctttctaccacattctgccatcccccattgataacaccgcaattatcaagaatcaactatcccaaattttttaagttattagataaagacactagaatgatttttatatgcatgcttcctcatgcaaaagccctatgggcttgaagcatggacaatgcatggtgggggcatggtatcagagcctctatgtccttgtcatatttctaacactgtaaatcagttgcataaaatgtttatggtgggcaacagccaacaggagatccaccttcatcatttttccttacttgtatggttcaatgaagtcatttttgagattaatatctatacctttagattacttcattttgagagcatggttctaacgttctgttaatgctatttgggagagaaaaatagaggaaattaataaattttggagatctcaaaggaaatgtaaagggtgaacaaagtatttttccctgacaggatagaaataacaaattaacacaatgagcatatgaaaaaagaaaactgcaattgtattgaaatcttaatcttcaagctgattatctttttattttgtgtaggggatgtacttactcagcaatattgcaagtggaaatgagtctcataaagaagctatcatgcagctactctctacaaaagcagaaaatgtgtctcactctttcttcaaccagtttctgcagagcaatgacagtcgattacgcacatctgctgtttgggtcgtagtaaatctcacttttcctgcaagtcctggggcatttggtaggattgtaaaactgcttaatgtaggcattgtttctcaaatcaagaagatggtcaacgatccttgcatggatgtgaaggtcttttaatcttcatttcaaactggtcttgttctatactctctttggagtcaaacataagtaaagaataactaattctcgctaattaagaatgttagttaacttcgtttaattttcttatatctcatttataaaatgaacttcatttcctaaatcatcgttcgtgctaattgatggaagacttcaattctctgggaacatgtttcaaatgggaatactctctccattttaaaagccatgtgattgatatcatgagaataaaaggagccattgaaaataaaatttgaattaaataaaaggcattttgggaatgatttcattaaatagggtggaatcaattaagattggcttatattttggaccactatacctgagtttagattcacttatattttggaccaccatacctgagttaagatttgcttatatttgagtctggaggaaatacttctcttagttattttgtagtttttttttttttttgatgcagcttcgtgcaagacaagcacttgggcagattattacttttggtgatagttaattgtaatcagttactccattcaaagcccttgggctgcagggaaaaagagaaatctcgatagattttattttctcccaattcccaccttatatgtaaggtgtatcggccttgtgcttcagcatcaagtatggtatgcttcagtggatgtatttcaatgacttccttgctgtctttcctagaggttcatttctattctatttatgcaggccactggaaaactttactaaatatgctattgaaaattggaattgttgactgttatttagttgttaattcctgcttaactttaattggttaatatgatataaagttggttgtagttaaatattcctatataggcacttcataaggatgatgattctatttctatctttgagatatgttcatatttatttaggctcaactgcgaagtagtcttttagttggggatgaagatttattttttcctcattatttttcatacttgctcgcccctgtttttagctttattttttgttctggtactagtttatcaataatatgtttctcttgaagttttttaacaatatgtatcatgttctactgtgtcaaattgagatacatggtttttttcttgtttcgctttgcaggtgtctaaaattacttgtatttttttgaaccagtcagagctgtgtgtgaagcactcctgaccaggttgccccgaagtctctttctctttcgctcacattgtgtattaccttttgtaagtcggaagatcgaagtagatttacaggctttagtattgtactgagtagtaaatgccaattttagaacttagtttcaatttcattctgatgctgggatattgacaaatggttggattctatgtgtaagcaacatgtcaaggggtaatgattgaggtgtattttgtaaattattgtgatgttttaatgaaaattctttgcgaaccatacttttttttgttgacagaactgcgaaccaaacttagcacttgtactttatacgtaacaacacaataatttacaaacaatgtttttttaggtatataatttaaaaaatgttgtttttttgcctttaattaatgttatatacatagccatcaagataatattattttaatttaaaggtagtccaattatattctatttgatttttgaaataagaggtatttaaattttaaaattttgaaaggtgaaaacaatcaacttgttattattcaaaagaataagatatgattccccaaaatacataataagataagatctattgctcaatttttttctttaatttaatttaactttgatgacataattctagtaaaaaagaatgaatttggaagaacggggggcggggaggaggaatatatacattaagtgactttgtattcatgctgtttgcatatgttgtcttttacagtggtagcatacaagtaaaagaattaaattagaacttctgtttgatttttttccttaaaaaatctttaattgagtaatttctttgagttaaatgagtagtaagtataatacaataatgtcttcagtttttttgaatgatagtctaattttgtttctttatatgaaaaacattttgcgaactttattttacttactaaaattaaaaaataagcattttattgatgaggaaaattaataattgaaaataagcatgtttttaacttttgaaaattactttcaattaaactgcacttctacttttttctgttcgtgataattgtaattctgcttgaggttgaatcatacatcgtgcaaggtattgagtaaaccaaccctgtggaagaaataaataatttctttacttttccataaacttccgaagctaacatggctaatagattctagcgattggttacactcaaacaaatgcctaaaatttttaatccctattgtaaatccttcatttcaaactatctaaataatggatcttatatggaaaggtatagagatatacacaatttacagaacgtatcactagcaaatctagtaagagaaaaagatacagataaccaatttagagagaaacagattgccattggaacaaaaaattatacctagactagggagaggtaagattaaaagacagaagggaaaagaagagatcgaaagtcctaacttatcagccgattttttcggtgtttgtgtcatctgaaggccatattacagtttccatgagccgttccctcatcaactccaagttttcatcagatatttcttgatatatctcagcgtgattacatttctgcatggcaataagaggtgaagaaaggttataatttggagtgcatcacccctttacagaagattatcacatgccttggagatcaaacgaaaagattgacatcgataattttgagttcaattaccttgatccatttgccataaaggtgaagccgtgttatcatcactctttcagcaagttgatgttgctcctagcaatcgagccaaaaaacataatgacatcatttccaatgttatcaggtaacacattgtgaaacgtaattatcaaaacaatatgtttttatagaaaattatatgaacaatatatcctgtggaaaggcattagacaagaaaattggaggtattgaatggaaggaaacacaaactgatcagtagtttattaagctatacaccgagtaattcggtagtagtttattgtgaaagtgttttcagcactgcaaaaagaccatagcatgcttacgaggatgatatttctttaaaccagcatcagtattggaaaacattgtggcagtttaacatttggcataggaagaaaacgaacagaaaaaacagcttaaaatagcaattcttgagctgcacttgaaatgttgtttatagtactttttaatttcaaaaaattaaacatgtaatagttcacaaaattgtagtaaattttcaagagagtaatcaaaagacaaaagactcaacttcctactctgaaaattatcaacaaatgatataactgagcagagcacatacctttgtgagggatcgtataaaatgtttcctatctgtcgggtcgtttgttgcaacgaaactgttatcatggaaaacaaccaacaattagctaaaaaattaaccttatactatgtctacaaaaagttgattaactttattatttgcttgtaataatctattaaggtccaaataaatgttgtagaaaactagaaattgcgaaaggtatcgatgtgcatttactacttgaccgctttatcgatcaagattcaagacttcttatgcaaatagatttcctgtattcacacattcacatttcggatacatattttaagctagattcatcgagataaaatacgagtctgtccgattttcattcaactgattagttgaatgcgtgaatgtggaaattccccaactgcagagaatcctaattcaacttttcataaggtgcaatcagagcaacttttcaactgggatcaagaatctatctatgagataccagttcaagtataataatcaaaccgaaccagagcacttccattgctggcagtggcaagttttgagagtagtaaacgcacacaaagagttctaattttacaataattaataaaaaaagagatacttacagttgaatgtatgcaatcttctctttttcacaagttcattcagtcaacaatttagaagcttacttaacatgtgactgaatggaaacatcattttttaaactaaaataaatagtaattagaagagcatagaagtttgagtggaaattagcattgtagctacaacaacatagatttcacttacttatagaaccacctatactgaggtgggttcatctcatacaactgttgaagaacagtcctcacagccttgtatgtgaaataattgagtatttgctgtatccaaataaaagatgaagccagtcaaattgcaagcaaggaatagtagtatactcagtggcggatccagaaaaataatcaagagagacactagtagcagattcaggagaatttatttatgtccgcacatttagtggcgggattcgggggcagcgcctctgcaattttttttttgtaaagaaaatttaaaggaacaaacaattataaatcataatctaaaggaacaaacaaataatcagaccaaattattattctggattgaatagaacaatgaaagaaacttattgaaacttgcgatgagatttcaaaagaccatgatgacaacatgagagttagtttagatataaatattgagtttgagatctttgaatatgaaactgttacaagatagactaaatatttctacaaaatacatatggttaaactgtacttctcatttcaatgaaaataatgactttaatcatcttataaacaagtactaatacataaattacaaatgaaaataattaacaaatactgcaaattatataataaacatttaaaataattaataaatactataaataagtactaaaagtatattaatattttaatgacaaaatttaaagtgtccccaacttataagctagatccgcccatgagtatattatatacacatagcaaaataattaattaaatattcattcacaatgaccctggagaaattagtaaataatctcggatcatcatctgactattaatgtctatatattaacagaaatattaaaactttacaatttattagaagaattaataatacttgatcacatgtcattcaaatattcacaacacattatagtttcggactagctaagaatttatgaagggagtgagtatgttaagtagcagtacctttttgacatcatgaaaagtgtcctcatattgaccaccgagctcattgacaatagtgagtctcttagtcttgtccttgtgcctgcgatgcttcttgaaaattgtattaacactgtgactctgaacgaaggaagtggtgagcctcaacctcaacaagtgcttcctattgagacacaaaacactgatactggtactactagggctggtggccagagcatccacgtacaaacgtgggcaactgtgccactccaccgcaacagatacaccaccaaccatcctatcctatcctcaaacacagatgaatgatagaagatgcatgctcttttggaaaaccaagctcggatttttaagtgaatcttgaccaaacaattattctgaggtcctaaattttcaaactaacgttgcctttttcaattcagttgcacacttgggtttgtcaccaatccacgcacacacatcgcgcgtgacatttaaatatgatcgatcaaggaaaagagtcaactgagcatacatgggtattgccttttcctgctaagtgctagcaactagcaaggataacataatggaattgttcaactattattaatgataagagaatagaatctagatactttgattttttatctttgtttttgcaaacatattctaatttatatattatatatgctaatttgaattgattaatagtatacactaaatataaattctacttttagaagatttctaatcatgttataatgaatttggagctagggagacctttttataatttttttaaagatattattaatgtaattttttttatctttcaacaaaaatatttttacttttaagtttattgactaatgtttttaggatatagtgattaacatttgtcttttttctaataagaaataaaaatgagaggaacgtttttacttttcatgttaaacctctttgttgtttttgaattttgctagaatgagtataagatgaggaattatggtgtaatcactaaaaatccccctttttaatcaacattttaaagttaccccaatttaaaagaatttagaagattttaaacaagcaagcagattataaataaactctatactcttccctttttttccatttccctctcctccgacctttttagtcaatgagcatatactcctcattttatttatataaaaactcctttttgacttgtgtttatctatccaaaattgattagaacttgcaaaaattcttggttattgtacctcaacagtggtaaatgtggcatgatatgcatataatatatgtacaaattaatgtataggagcaaatgcatgacccacgtctgtccaaaaaacccttctagtaggatcctatatatggagaagcaacaaaaaagcaatttgaaaactctgtgaggtgtggtgtggtgtgattctgattagattaggtgatgccacgaggactagaagacaaaaactctgctatttttcaacgctcttaatcaattaaataattcacagacaaacatatcagtcagtgacagtggctgaatagctttggatcaatgaacaaaactctgcttctcggccacgggccactcagcgttattggttatgtagacagataacaaaaaataattattatattactatctatccttctcaaatctcaactgttttattcacttactacattttaatttgttttatgcagaacttaaacatgttaaacatctgtttgcattaattttccatctatttacaaattaactaataaaaatttattttaattcagatgaaaaaatatctacaaattaattaataaaaaaatattttaatatataatttttttcttctcctaaaaatatttttcaaaaaagcttattcaaacatgccagaattctactaagattagtcaaatataatttggaaagaaaattaacgttaagtttaaaattgaaagcaactatcacacctttatttgtaaaatgaagacacgtatagctcctgtccctcccctctttgtctttagttgaagaattgattcattttttctgtcacgtatgttaattattagcatgtttggattagattttttttaaaaatcatattgaaagtcaaagtaatatatagttttaatattttttttctttcaaaatttcaccttaattttgggtctcagaattaattatagtagctatccaaacaaaatttatatagctatccaaacataatataagtagtattgttatttaaaaaaataaaagttatatgttggactagcgtactaagttcaaatctcaccttgaaaagaaatttgaagttttaatattggactagattttattatttttaaaagtatataaggatctgatttgagaaaattagagaccaaaattatccctttgataaactactaaaattacctttaaaaaagattttttattttccttcttaatcacaaattttgttgttgtaaaatcacccatttgatataactactaaaaccactcatttgataaattaattgtggggactggtaatacaattaagtctttaaatagtgataaaaaataatttagttattaaatttcttgatttttgcataaaaattaattttgttgtatttttatagttgataaactaattaaaatagtgttgcagtttttggatagctaggaatgttattttgataataaataactttaattaaaaatgttacgactttcaaatgactttacagccaatagaaagggataagtggagaaaaaaaattattttgaataaatgtggttgaaattgtttcgtactctttgtcatttccctttttaattaaagttcaaaatttattaaggtcttaaaagttgtactaaattttgaaatctattttgataaaggtcttaaagttcaaaatctaaagctacgtgtggtagcctacaaactaatgtgtgcatgtaattaaaaactccaaaataaaagaatagtgtggatgtgtcaccgaccctttttagtgatccaaaaacttaaagtcatcgtacaccaaatataagtccaataggtcccagaatatttgaacgagccactttttcacccctctttgtcggccattctaatttataaccataatataggcccccaagacaagacgtatatatgtacgagtgtgaaaatctctgcctccaattccttctcctttttccctccctacctagggttaaatggaggtaaagcccaacaaagagataaaaagaatacagatataatactaattaatttacgtactttagtaagtgttagaagatttttccttcgtaaatgtgcatgagagagttattattatacacaactttatttttatatatattaatttggtctccttttaaagaaatcttgtcgtcttggattccttatttcatcacttgtccattctttagtgtaagtgtcatagtaaaaggagttgctttttcggtgtcagctactacacaaaatgttatagattctttcttgaggaatcattacttcatttcttttgtcatacgagagataaacataagaaaatttacatcaataataaatcatttataagactacattttaatcaaaaacttgaagttaaaatttatgaatctttttcacagtcatataatattcaaccttttcatttttattcaatctaaagcttcgtctcatacacttattacttcagcatttacaaaatcctcttttggacaaatatatatcatttccattttaaagcactctccaataggataagcttgtgtcctctcctgttacactagttagttatatcttctctacctggttaagtctcaggcttcttcttccaattgccagctttttgttttagaaacatttaccagttcttttaattaacctagcttatagctagctgactcacacaagcattttctatcaagacatggttccttctggaagtacgacaaaaccaacaacttcaagaaaaaagaaaaaaacaagaggaaagctggcaagaagccattgcaagaagcagcatgaagagagaagaaaacaagaaacaccaaagaaaagggacatggattctgatgttgctgctgctgtgtgttccactcccaaaggtgaaaagtttcggataccagaagtttcaacatgccctccagcaccaaagaagaatccaagggtgctttctgattgctctttgcgtagatcacccttaccattctatgcaccaccagacatagagaccttcttctgctttgcgcttcaagatcttcccgtttcatttgtttgctaatatatatatatatatatatatatatatatatatatatatatatataagtagacgatctcgtgaaactttagaacatgcatggacttttcttatgtacttttagttttttctacatctcttgcaaatgagaggtatatgctttgagagaaccttggaggattttggagtgattgatcttaggaacagttattcaccctatctttctgctaactttaggagggtaacaacttgtaggatttgtctctctctaaatttagctaggggtacgtgtgctctcctaattagatatagattttaagtttattttcttttttctctgttatatatagaagatatattttctgaccttaatttgaagggtgctgtgatgagtgcaaagaatattggttttggttgtagatttgagcgtcatagcttggaattctacaaaacaaaacatagtttagtcaagtggttgctctgagagaaattaaagtccatcatattatcatatatatatatatacttcctttctgttcaatttcatcttttattttatttcttctactaatttcttctgcacaactgatgatggttataagtttgatatttagttagtagctacgtaccttttgtctttaaaaaacttgtgtgggtagatgacccttccatttataacgataaaaggattttcgatcgttggcaaaattaatcttatcaaattaaagagttaaaatatagttataaattctttaaaatattcaggtgatcagatgccaataaacgaattgatataatatgggagaaaaataattaatatatttaattttataaaatgaaacatattttgagacaaaccaaaatataatgagatgagatggagaaattattttgttatgtattgattgtattttgacacatctaggctgtatttttaggagtttaattccgggcaataatttgtaattagtatttttttattcataagttgtaattggtatgcctaaatcccactaataagtgtgtgtattttggtttttggtttttcaaacaaaaaatgaaataaaagtgaaatgttattttaaaaatctgaaataattttgtcagatgtgtgactgtactatacgtgtctctgagttcggccccacagtctatgagaatccaatgaaggggtctctcttattagagaatgagaatctcaagaaatttctcatatttttgcttttattttatgttgctaaatgctacttgctctactcgcttgtcgctactcatacgggaatttatttttctgtgataaaataagagtagtggaattgatgatctatacttatatagtgtccctcaaatgttactattttttttttttttttgctacttggtttataatcattatttgtagcaatagccttgcgtgtgtaaatgtacacatgcacacagatagatactttggaattaaggttttaaattacgattgcacgtagtttcgtcgttttttttatattgtaaaaaattaaagataaatatatatataactacggttacaaatacttcaaaaatcttaacaaagtaaaattaaaaattagagtcgtagaatattttctaaaaccttattcggagtaaaggaatagaagaaatgaattgaatgttgtgtgtggtgtgccatatgtgatatgtggtaatatttttgtacatgtataaagaaataattaaggaatatccttgaataaggatgtatgattctttccaaggatctatttgtgtgggggtagttgtacttagaatttttttaactttttaaatttatttatatggatctaccatctcttaaaatgggcctaaaagatgtacatattatagaggccagaatccatactttccgacctatcgaattaattatgtgtaaatttaaatacaatatagaaactaacaaaatttggcatatagttgacagacaataagttttttaagcatacggattatgatttaattttcttactatatatatgaaaaatattttgttgaaaatagttatatccacgttagtaatttctcaactttgaaagagattaatttccaatgtatcaaatgaaaaattcctttgatgtacaaaataaattttaatatatatatttttcatttatagaaatcaaatttaaacaccaaaaaataaaacaactcaacagagtaaaatgaattgtgctagatgctcttagtttaaaaatatgtttaagtaatcatataacatataagtaactttagattattatttttaaaagtaactctatcactgataaaatataaatatgtcttataccttcgtaattcatcatgcagagacatggagcttatatgccagttcgccactactatttgcgttttttactttttagtgtaaaataaagtgactaaatgggaagcaaaagtgcaacctgaacacgcgctattgcgaaaaggtagcatgtaattattttgtgttgaaaaaatataattgaaattgccaatagtgcctgcaagtagtacatggggtacacaatagaaggttctagcgtctatgtagtgtatatgttggacatgtcactcgttcaactagtgtgtctaacataaatattttttaagatttttgggttagtttggtacgagaaaaaatgagagaaaaaaataaaaaataaaaaaaatgattaatgaaataatttttttgtttatttaaaaaaatgaaaaaaaaatatttttaaatacaaaaatttaaattttttcttccctcactttttttctaattcaaattttaattttttttcttttttatttttcttccatccaacccaacataggattaggttaatattttttaaaaaaaataaaaatgcttacatgtcatgaaaaaaaactactttgactggcatgctatttaaatctatagtcaaaacaaatcccctatggttaatattcgaaaataatcctatattcgtcggtagtttctaaaaatgttccaatttagtcaattaacccctaaagtagtgatatttttggaagctaattatcataataggatgctctaaaaccttaccaaatttgattattttaacattgatcaggttaacttgtcagttaaacaagtgggttccaaaccacatcaacatttttatttttttttaaatattttttattgagaatccacatgacacatcatgtccaaaaaaacttcacgatcataagcaaaattcaaaatccaaaagaaaaaacaacatcgagttcactacatatatatcatgtgtctagacacacaaagatgacattactaccaactaaaaaaataggtatctttgacacatggcaacatctagataaacctgctattttatttacgacgtgtctacatctacataacgacatcataaacaaaatccaaaatccaaaaatattgaacttcaacccaagacacataacaacacccagcaaaatatgccaataataacaataatttcttgataattccgtatagtattgatattatatatatggacgaacagcgggttcaatgcatgtatgttatgtgtctagacacattaaggtcgcgaaaataaaaataaaaagagtgactttgacacatggtaacaactagacaaacttggtagtatgcttacaacatgaataactaaccgttgttgttggcaataataataatagcaataatatataataataataataataataccttgtagaccattaaaaggattcattatagaaagccactaaacattagctaattgttgactatttgatatgtgaccaaagcgtaacttttatttattaattagtatattttcttctcacaaataatactaaatacgtataacaactcatcgcacattagtgttaataaaatataaatatttatttaagaatacaatcgaaattatttaaataatgcttgatttcaataacttccatttacttaaattatttgttatattttaaattattcaaaacattctttataaacttaaataatataaaatctataattttttacaatataattataaaataattaaattattatataatttcacttttaaatttgaaacacatttaaatttatagagtaaattcattactttcttctgattttataccagaaagaaaactactttcttgtgatcttccacgtggatggatatcgtccgaactgaattagacccaacaaagtaaacaaacattgaaccaaacatgattaaaaggtaaattcttactttatagcaaagttattaaaatcggatcgaaccagccagtcctactggttggatcgggaatcagtaacataaccgatttgattatactattaaatcagtcatgcagttgacttggtcaaactcgatcaaaatcagccaaatcagacaaatcggatggttttcaaaacccgggtttgaaaacgcacaccagaaaatgaatatggcacaacagaaaaacaaaaggaagagaaagaggaagaggagaggtgatgaacatagaggagaggaagaggtgtgcagcacatgaaaatggaagcgcgtagcagccacgcaaatgaaattggagaagcagcgacagctactcaacacctatattattaggattaggttatagctttggccttcatttgcttttttatcccttttattaatttctatagtccttttgactcatttttttattaaaaattgggtttgtattttaatttaattagttattatttatactctattttattattaatacactttacttatattaacaattttaatatttcaattgatattttgaatttttgaatatattttttaatcaaataatattagttatatatttatatataatataattttaaaatttttaatatagaccgattcaaaccggtttaattattgacccatcagttgaaccactaaatcactgatccattatcttaaccgattcaatgatgaaatcggtttttacaataagtatagtaaataaaataaaaggcaaatacttttaaaataattaagaaaaatagacgaagcccttaaattactccgagaaaaagaagaaaaaaacgacaacaacttaaaaaagtggtgccacgttttgcaagagatctcaatttgtttaatttagaagtgactaataaaataataaattgaattgtttatgggctgtgacgtgataataggtgtcccctcagtcctcactggcaggtaaggctcacctttcccccttttttaaagtaaagaaaatagagttaattatatggtggagaatcaattattaatccgaggaaactaaaaaaaaagatgtttacaaaggaaaatggacacgtgcctcacattgctgtcaattctcggaggctatggtccccacccttaggccacgcgtccaccggattctgctagtcaagtgcctgtcacgtggcccataaattgtgttcctttttccttctcaggggctctgatatcctcacccaccctccccctctcagatacccttttccctcccatttctctccacgtgtctcctccgtgaaacttgatgctgacgtcatcataagatgtcacttgaaatttaaacaggcaaggcaacactggactacatttgctattgttgttaagatttttttactttttattttttattttcactttgactcgtgaatgaattcctttatcctcatatatcacaactgaagtgagatatcaacattcagcaccccaaattctagttatagagaaagcaaagttctttgatttgccttcctacccccttaatttcctttattaatcaattgggaaatttggtctaattgtgattcattctctttgggggattttgaggattagggttagtattttctgtgtctgcatgtgtgaattctggcaagatatcacccaaaccttattttttttctatgacatgtgatgtgtgaatgttttctggtagcaaatgtgggagaattgggattttggtgcatgtactaggatcagataaactccaaattttggtgattttctattaaatgtagctcactagctagtgtgtatctgcttatgtgaacactagctatggttgcatgttggaatatcagtatatcacctggggctgtttggttgtgtgcctaaatatatggcagaaacaactgttgctgattatgattttgttcttctaggggcatttggttgctgggcactgaccaagagttgaaagattttatatttaccttcaaacagctgcggctcctgctgaagatcaagtaagagcaaaatggaaactatttttgttttaagcctctgtttgcttaacaagtattatatcatttcatgatgaattttaataattttgaatttgggtttctcaattttctttaagttgcacatgtcttataacttcacacatatgaggctatgaaactttttaatgtggctttactatcaatcagcatgctgcattttaagagcctttcattaatgaagctatgaacaagcagtagcactattgtaactttctgtgagttgtgcttgatatcatattgatcaatttgtacctctagaagatttggacatcaacgttcctgagacaattatggctatagttttcacttcacgtgattttgtttcagaaataccttgtttatccatttttttaattccattggagggtctcttattgtaaaggggaataaccactgtcattatcaacttttatttatcttgccttttgttttagcataaggaataaaatttgtaatccaatattcatttgtagggaactagggttctgaagataagatatgcaatccaaatctgaaactgcaaatcaactgaggtctgatccacattcctttacacctaaccatgcttattctgaaccctggtggcgaggtattcagtgcaatcctgtcccccaagcaatgtcaggagtgaatgcttctaattcatcttcacttgaacgccctaatggtgattcagaatccagtgaagaagatgatgatgccactaaagaaccacaacccactgctcctaatcaatcaggtgctttagattgattgtaaagaaaaatataagcattaaaataagaaaagaaaaaatttgcttatatatagtggcccaaattatgttcatttgattttttttattttagtccaagtgttacaaggttacgaggatattgaaatacaatattcttttcttggaaggaaattatggacaagaccaccaagcgatgcaacattcttcatcatctgcacctttggtgcgtgatgattgccttacacaggctccacaactggaacttgttggccactcaattgtaagactttgcccttttgttattttttatttttattttttagcatgaagagagggtgcaaagatcatagctttatgactatgtttaatagaataaatgtttgctgatttctgcatgtcaatgatgaaaattcaattattggaaaaattattgtcaaatcttgcatgcttttctaatggatcctagtatgcttcaaattcttttactacaggcatgtgcttcaaatccttattacgggggtatgatggtagcacatgtgcaccaacagttggcatgtgagactaaccagtgctcatacaatttttttttttttacatgtagtttgtcaaactcactgttttgcatttcccataaatcaatctggttagaaatgtagtttgtgcataaccctgaaggatagattcttattacatgataattttgtttcatgctatttgttttttttttttttttttcctgtttcaaacaatggtgacattgggatatcactgcaatggtataacatattatattttcactattagggatacgctccttttataggaatgcctcatgccagaatggctttgccccttgagatggctcaagagcctgtttatgtgaatgccaaacaataccaaggaattctgagacgaagacaggctcgtgctaaagcagagcttgaaaagaaattaataaaagtcagaaaggtacaaatgtgcactagcttatgcttctgtaggcatgattgttactctatagttctgtagttaattgccttaatctattttggaaagtgatatctcaacacatttcaggtttgggatatttgtcaacttattttattttacattgttctacaaccaatttcctttctgcagagctaaaactttagtttgacatgaaggagttttaactgtgtttatatctacacaggataccaaagtaagataattggaaatctagtaacctctgaaccgttgaacttttgaaaatcagtagaagattttaacaagagtgctgctttacctaaatgtgaaatgctatggatcttgaaagactcaataaattaagaagaataagatgttatcttcatttaggtttacacaaacatgtgtcaaaaatcaaaatttgtttttaatgagacaggttggcttctagtataatactgtgtacttcatattttgtacatgcaaatctgcgatccttgggcatactatactaacttctatttcttcacagccttatcttcatgaatcccggcatcagcatgctataagaagagcacgaggtaatggagggcgttttgcaaagaaaactgaagttaaggcttcaaaccacatgaacaaggaaaaggatatgggtactggccaagtcccattgtcacgttcaattagttcatctggttttggatcactgccctctgattctgccgagacctggaattcgcctagtgtgcaacaagatgcaagaggatctcaagtgcatgagagatttgaagaacacaactatgcaaatgttttgcagtcatcatctactttttgtttgcactcaggtgaaagagcggaggaaggggactgttcaggtcaacaacggggaagcatctcgtcggagcacacctcacagaggcgtcttgccattcagtaaaccattgcatggagtttgatgctgagattggtatataattagtggagtagtaggttgagtctgtaaacattggcaatttgcatgtcaagcggcaaatcattcttggctgtgtttctgctgttcatgatatggggagaagaatgattgattggaccatcatatttgtgtcgttgaaatcaaccagtccttcattatattctcttttgcattttgtacaaagatagtagtgagctaagtcaagccaacgaatcagaagacttgatgaaaagaactctttgatctactgactcactttcctatggcggctttattttatgtaactcaccggttattaatgttaaatatgagacattataagagatttgctgcatgattgtattcgcatcttcttaggcttttgacattttttttaccttgcttttgtgtgtcatcaggtcattagttcgactgaagtttgaatgtttgatctcatctagttaacgaaacttgcagtaactgttgggtaaatcaaaaacagaatgcttcacgtttcttgaaatactccaattttgtcatgctctgaatggaaatgcaaagaacatggatgttttgcagtttaacaataaattttaacaaagggaatagattgtttagtacattaaatactgtattttttacaatagggaatcccatccaaagctaagatcgagttccaccaaagttactgaagtaaaaggtcaacaacattgcagggtcacttgtgaggagcttctaattataccaagcttggcttaatctaaatattatcgataagacttaaaacaaaaaatcaattagagctgaaaatttccccacgaaatagaaaaaaagtccactttcaatttgtttgtataacatagtggaagaagaaccgaggaagtagaaatgttgagtttgagttcattcattcagtagtggataccttccgcatgttaccaaatacagaaccaccagtcctattgaaaatatgagagaatctgcatgtttaatgtccaactggattcagtgcagtctcctattccttgcatttgcaaccgttcaataaagatcgtgtcttcatctaatggttccaagttactaactgagtgaatgtgtggaaaggccattgcaacgattaaaatggaagaaaaaataaagtaggctatctgagtctaattccttggagaggtctcaaagcttctcagcctattttttcagttactattcctttaatacatccagtaagagtgaacaatccaaataaaaagccaaaaatgctgaaagtccgaagcagtacccacttactcgtccatgatacagtactggactgactcaagtatatttccaccggaaaatatatggtcaatggccaaaaaatgatgctacccagaacccccaaaatctgattgaagtagggaaatatgattgcaatcacagttgttgatgcaacataagcagttcggaaagacaggctgagaaaattaagttcaaaggctggaagcaacgggagtttcaacatatatatgtgattcacaaattcactatctgggaatctaaaacggaaccaattctcaacagtggcaaaaagtggctggctatacacctgcaccaaaacaagttagatgacacttaaatgaacatgcattctaatttctataatgtaaaatagtacagacaagtagactatatgatgatttcataacacactaccctaagacaggtgatggagaatataggaattgaagagatatcaaatgggagcaccatactaagaattattgacatggtatctctatatttatatgtacctgatatgaaccaactaggtgaaccactatacaagcattagcaaagttcacaagccaataagacttggatgatccaaaacccgttaaaaggtttcctggtgtattatcaccaaaggcagcatatccagcacctccacaactgaggtacacgaatgttgtgacggtgaccgctattactgaggcctttttcatggtttggttttctggtggaggcgatttcaaagtatccttcaaggattgcagtagattatatcagtctttataattgttaaaatccccccacccccccgagctgtggtcaagttacattctggttatctgagttcacggggtatgtacctgtatttccataagaattgttgagaacggatatgagaatgatatgtcaccaagtgcttgagaaaccagccataacttttcagctccactggaggtactaattcctccaatgctaccctcagcatgtcctttttctgagcaattttttttcataaaattatattttctacataataattagtccaatatatatttttcaagcaaacgtccatgcacaagccagtcattgtgagcctaagcaaagactcgccatacgcatacctatgatttgagcaatggaaagccccagtcctatgaaagaataagtaaaggacataattgcagcaacaaccgacagccatttgatgttatggaagttgggtatctgtgagagaacaatttggatagccccaaaaagcagcatataatatgcatctacagattcacatgctgcttcaggcccttcgttgtggtaacaaaatgaattttggattgttctgcagccacaaataaaaatagcagttcaaatttaatattggcaacatagggtgagattcttgggatagacacatgcttccttagtggagtaccagtgtaaaaatcttgttttgcacaaacggatgaaaagaagaacaaagaaaaggaaatgacagaacaggagaggaagcagtatgataagtgatgaatcaacacaccttaagctgatagctgttgtgatgacgaaggcaattgcaaaaccatacagacttatattcacaagaaggccactgagccgtccattgcttaatcctgttaccaccgaaagaggatcttatcttataaaataacattctagcctatagaaccatatcaaatgttccaaatgaggtaattggaaggagtataatcgatcgttcatctggagacactcataagattttttcaatacacaagagtcgatgttaaattgtagaagaaaagaaagggaattgtaccttgtacgtacctaaatgcaaatgaacaacatcaaggtaggaggcactcctattgggaccatattcgggatggggatggcgataagtgttgcatagaagaaaagaagagaagagagtggtggaagcaatgagaaggatgcagaatgggcctaaaagccacccaagctgtgcagtgctccatggcagagacagcactcccgatcctatcaccccagtcactatgtgtgccactgctgtccacaccgtcccttcatcacattcacaacacacaccaccatgttacttagttatactatactataatctattcacttttgcacaaaacaaaacattttagatgacaacacaacacaaacctgtccttttgagagattgggtgagtaacagtgggaggttgtcatttgactcagtctgagctgacacacccatcttcacaccaatatcagatcagatgctatgtcatctttgccacttccattcctgtgaccttaaataaaagccacacagggagaaaatgggaagacacaatttggatttttctcctgttgttgttacagccatgatgggcaaaaatgtcaaaagcccatgtgggaaaaagaaggaaggattaccaagagtgtaatgccaaaagctgctactagtcagcgaaataaaataacttccgttttttttttttcttgacaaacgcgccgactagtatcataagaatattaaaaagttaaaagaaaataaatgtttttattagaaaaaatagtattttttatgatttatacaataaatatttttttcttttagtacgttgataatgtcttaataaatcggactttatttatttatttatttagtttaattatttttttcatttattttatagaagatagtcttcgcacactcgcactctgagacagtcttaagtgtatgttgttggtttgggctgcatgcatcgttgtttgacaaattacgtaagatagtactgcacattagaccttagtacaatacacataaccccaaaaaacaatttaggatttaaagtgtgtttttaaatttattttttattttttattttttgaaaatactatttttcataattaaaaatatactaaaaatgtttgataaataaaatagaataaaacaaaaggaatataattaatttttgttttatgttttctacatattagtatatgatccataaatgacattttttattttaaaaaataaaatcaaagatcaaccataaaatatagatccgtgtggtaaacgcaacaataaaatatatttccgtgtgataaacgcaactataaaatagaacgagactaaatgattaaaacaataatatattttaagatgataaacgcaaccataaaatatcgaaaacaaccttctatagccggtccaagatatggtccataatggatcatatgtttcactggtccaccgaagttttgccctgtaaaccactctcgtatatggaaaaataaggggtgactgaaaatgagatgcacctttttgaaataactggagtgctgggaacaataaatggttgattagatttctgttaagactgcctcttaaacaaaatcaagtaagaatccatcaataacttttgtaaacaatgtttaggacaaactacctcaagtcagcaatcttacattcttagaatgtcctattctaacaacatagccaataacatgccatcaggaacagatccatttcaagtcatcaaagagcagttatcattctctttatctcagcagatctgctgggatccggttcttcaattgttctctcggtaagtacttgcttgatgcggcacattgactttctcacctgatttcacaaattaaattgacagaattactgattaatttccttatttatcacatcaaattaatatcaatttcagaatattagtttctaataaaatcgattctcccataatacattcttgaagaggaacagaaagtgtgactaagtcccaaccaaaaattagttccattaccgattcaaaggaccaaaacttgtgggaatatcttaactggagtcaaagaccctaattaggatgacaaaaaaaaaaagaatactagtttgtattctctctgcttccttccctacctaaatccctataatctcaacactatctattatagaagttaaacatgcaacattcaaattctctctaatcaaatctatacaaaacattgttcatgaaaataagataaaagcaccacttctgtgatttttctatgccaaacgtagacataactaagggtaagaaaaggccaagagcaacatttatgtaacacagaacaagggaaaagaagtgaagtaataccttggggatgcgctcaggttaggaaaacgcaggctctgtgcattaagtatctgacgttgagtcatcaacatgttcttctcctttaacaacacacaccacaacttatgaaggtcttcccaagattttagacgcaattccgatgccttccaactccgacctaacaacaaatagataaaaaagtaaacaaattcataaccagagcaaaaaaacggcacaactttcaaaggtcaatgaagaaaatcagaaatatttgtactagacaagtctgatcataatgaaaatcagagaaaaattgtcatcccaaatccaaatgaacaaaagaggtgcctagtgcataccatatacaacaggtttgtcatcgtcagggctcctgtctgcctcaaagaactctccttgctaccaacagcagctgtagtggcataaggttttgatctggcagcagcagcggcaaagagtgtttgtccaattctgctctgtattttgacatataccagtattttttgacagacaaacttagctattgaaaaaacaaaaaacaaaacaacaagagccaaaccagtatccataatatcacatagaaaccaattccattgcattaatcatcaaagttcaaaataagtcgaactaatcaatctatatattatgaagaagtaaatataaatgagaaaatgattacaataaatctctagttatatctacatagtcatctattctaatttgaaatgaagaattgatttgttgtatgcgattcaagctgtcaccgtagtatctatgcctttgtggtgcagtaagagttaggggagcttcctccttaaataagcctataagaggacacaactaaataaggttagcaaacaaattgacagaatttcaatgctaaaaattacaaaataattgaaaaacgtatacttgcacaaagtaaaaatcgtgaacctatccaatagcaatgattcaattatgtgcaatagttaagggttgactactaagtgggaaaaaaatgcaaacttggataaagtggaccaacaaaacatcttacctattaataataacacaatccatgtcaagaatagatatccaattatcaaaacttgctacttattattttaaacatacaaataggagattgcttccaccttgttttgagccaaagagttgagcatattcaatatgtcatcgctaaagttcccaaatcctatcatcacgaactagaatccaataatcctcacccttacctaacaaagctgccattgctcaataattgccataaacatcaaacaaaaattcaacattaagacaaaaattgtgtcacgtcatcttcttttatttccacgaatattaaggtaataatcaatattttcatgtttgttaagagattatgataatatattttcagatataagttattctcaagaaagttatactcataagttttaaacattttctattcctacaaggtgttagagataaatatgtatgtccaagatacaattcatcatgtcattaattttaataaaaaattgttctttatttattatatttattattttattaaattgttaatttgagaagtctttgattaaaattagaaagttgttatcatgatagagattatgataatgagaaataagtctttataattttaatctaaattattttttaatataggattattgtgaatatgatatatataatctagatagatcaatatacgtgtaatggtctttattggataaagattaatatatctcatttattaaattgcatatatagataatgtacatgtgaatgtcatcattgaactgattcaattaaaaaattttaatagttaatattaccttgatatgtcaataggaagttctcaataagaaatataataatttttttacatgagattatcatagtaattaacaagttatttatgttgttttaattttgaacacctaatgccttatgacactagttgatgaatagttgaatgaatattggatatgattaaatatttgtagaattaatgattaattaaaaaggaatccataaactttaggtaataattgagctctataatagaattaagaccttggttaggacaattggaggaaaaaagaaaagagtttcttaggtcattcgttaattagatgtgttagcttattaaagtttgacaataataatatactctaaagttaaccttagatgtaaatgatggaagtaaatattacattaattattcttctattggttcttgaaagtaaaagactttaagggtgttgatagatgtctaccttgattagtaaattaattatgattaaattactatcgatttaacattgaaacagggtcacgcacaaatgaaatgaatgtttcaatctttgtaaaagaaaataatttatttgataattaaattagagaatttaatcaaataaatattctagtgaaatattattttattatataattaatataaaaaagagtattattttataaatgtgaaagttgttcataaaataaaaataatattttattgcttattaaattagatatatgagataacttttatttttataaaaaataaagagatataatttttttttctccctttgaaaaggcccaactccataactttttaacattataaacagaagtatttactacaccagaaaaaattaaaaaagttcaagttagttttttttagtgagaaacagaaagaaaatttatttttcagagtttcactcattatagaattgaaaaaattaaaaaaattaaaatctaattttttatgtgagaagtagaaagaaagttagaaagttagaaactttattgttcgaaatttcactcatcaaaaaattgataatagatattaatttacttaattgaagaaaatttttgttatttcaaaaatgtaaataatataaataaacaaatctatttttttctatttattatgtgttatatatattttgaatacaaaataaatcctaattttactctccaaactatcaataagatgaggacatttgaatcgaaacccatttgtaataggctactaatcttttaaagttttaactgtattataaaggtaagaaacctagcctttctttgcctcctctgactgtcttctaccggccaccgcaaacaaccaccgacctccgttctactggtagagtagtggtggtcgattgacaatatatattgattcagatgtaatgtaatgtaagacgttggggtccttttgtttcatgctaaatacagaaccataatctcttgtttcttcttcttcagcttccattttggttcaacgagcaagcgcttgtcgttgtttccctaagcatggcgcataggttgctcagagatcacgaagccgacggttgggaacgctccgacttccccatcatctgcgaatcctgcctcggcgacagcccctatgttcgaatggtctgtttcggatcctcttcgtttgttaggttttttttttttctcttttgttcttgcgagattgaatgagttattattggaatattaatagttatagtgataataaaaataatgattgtttagtgaggaattaaaggttgaaggaacaactaaactgagtcagattttaatgtgtggaacctcgtcatgtgaccagctactaagaatagaagagttaatttgttcaatagctttggtttgcgctttgcagtatttttatcctgagaatgagaaatttctagatggcaactgctaagtttaaaaccttttatgttattcaggcaggccaatggttttgttttcaaatgtctgaacttggattcctggagcatcttagcttaattcttctagggcttttcaaatgaaagagcttaattatttcaatttttttcatctttgaagtatcgaacagtaagttttttttttatcacagagtagttaatgttgaaatttaaaatggtatagttgatttactggtgtactatgaaaaactatggagtcgagggagtccgtgaatgtgcttagttaataattttcagatttcagcatcttccattaaagatgagattgtgggaatccaattatttgttcaattgcttttcattatgcttatctttcggtgcagacaagagcagagtatgacaaggagtgcaagatttgtacacggccattcactgtttttagatggagacctggtcgagatgcaagatataagaaaactgagatctgtcagacatgtagtaaattgaaaaatgtctgtcaagtgtgccttctggatcttgagtatggactaccagttcaagtccgagacacagctctcagtattgattcccatgatgccattccaaagagtgatgttaatcgggagtattttgctgaagagcatgaccgtagggtatgtttttcttatgctaagtcatgtttatagtttatgatagctgaacataattaatgattggaaaactagttatgggtttaaagtcattctgtatgtagtcatgagtgaattgttatttttgtggcttgcatggtttttgtaatattttggagtttttttttttttttacatgaagaatttctcaaccctggaactctgattttcacattctaaattgacaatagctattaaaatttcaaattttctttatccatttttttaagaatctataagactactattttgactcagttctctttggtcattacttgatcgtgatctttttactaagaataaaagcatggtgcaggctagagctggtatagattatgaatcctcttatggtaaagtacgcccaaatgatactatcatgaagcttcaaagaacaacaccatactacaaaagaaaccgggcacatatttgcagtttctacattaggggtgagtgtaccagaggagctgagtgcccttatagacatgagatgccagaaactggggaattgtctcaacaaaatattaaagatcgttattatgggtatgtatggttaaaaatgacttccttatttgcttttgacttttcttactcgatctctctttcaattgctcttttttagttttttaatgtattggcatttggcactgggcagcaactcaagcattttttatctctgtgatggatatagttgttggtttattaggcactcagttcttttgtggttgttctgtgtgacgaactattgtgtagctaagataataagcttgcaggtttttttttcccagcaaagtcatgtgatagttctgcttgtaggaagctttgttttaaacaacaataatcaagccttgttccaccaagtggggtcagatatacaagtcaaaaccactatttgacattaacatttggggatccaaagtggcaaaattttattgcttactaagttttcttaattgttggtacaaaaaaaaagcagctgattcagtagcacgggctacaataagagctcggtgtcattatgttaataaaaagtggctaataactgccatttacttgcaattttggctttcttttttttccttctatatgtggctaaactgaagtcatgtattgtattgttctcagtatttagtgaagtggaatggcttatcttgcctgcattgtccttagcctgtaatttttcgtacttttaagaatgttttctttgtactttgctacttgtcgatatgtagtaagagaattttttgacatggatgaaggttgattcctttataatatgttacgtttaattttccattgtggccaaaaatgatgtagcagacagtcaacagccatcaaatatcttattgtgaggataaccttttggttctatattttagtgctatatgtgtataaagattattccttttcaatctcattaacgtatcctctacttattcttagttttctctgcatgaattccttgtgactacagatactgatgatatttctagttgcagtagttggtgtttttaattttgcttcatggttttgacttcattagtttgctgttcatgctttaaaacgttcagggtgaatgatccagtggccttgaagctacttggtaaggcgggggaaatgaacactctggaggctcctgaagatgagaacattaaaactctctatgtaggtggacttgatgctagggtcactgagcaggatttgcgggatcacttctatgcgcacggagaaatcgaatccatcaaaatggttctccaacgggcttgtgcttttgtaacatatacaaccagagaaggtgcagaaaaggcagcagaagaactctccaacaaactggtcattaagggccttaggctaaagctgatgtggggcaggcctcagacatcgaaacctgagtcagatggctctgatcaagcaaggcagcaggcttctgtggctcatagtggattgttgcctcgggcagtgatatcacagcagcagaatcaggaccaaatacaaggaatggtttactataacaatccaccaggaccaccacctcttcagcaggaaagaagctactacccatctatggatcctcaaagaatgggtgctcttgttgcatctcaagatggtcctcctggtgggccttctgggtcaggggagaacaagcctagtttggagaagcagcaaatgcaaaattatacccatccaatgatgccacctccgcctggccaatatcatcatcagtattatcctccatatggttatatgccaccagttcccccttatcaacagtacccatcttcatacaatgctgcagtggctccatcccagccaccagctgcaaatcatgcttatcagcattctatgcagccagggtcttcacagacagggtctggacaggctgcacatgccccagctgaatctggaacctcaacatcaggatcgcagcagcattaaacttgcccatatactgatgtttctagctatgtttaagtttttccttaaactaactatgctgtcatggaagatattttcactcaagttgtcaatttactatctctactagctcgatattgatttcctcgtggcttgaacaagttattttataatttgattttgtgattttgaaactcttggcttcctggttaaatcatagtcatgctcagctttagtactacttaatgaattctaatgatactacaactgaacttttgttttggatataaagcatttagtaaagatggccaattgattttataccgaccaataattcgtgaagaatgtagattgttttagaactctctattgccgagggttgtgttttttctttattttgaaaagcttccattggttctttctttcttttctctttttggttatagtacgctcgtgtataattcttgaagagtgtagattgtttcagaactctctattgccgagggttgtgttttttctttattttgaaaagcttccattggttctttctttcttttctctttttggttatagtacgctcgtgtgggcactcttttgttaatcttaatgataaagtaatatatgaatgattaagataacgagggcctttcattcctaaactgtgcatttgcatctgacattttgacattcatctttctgtatacccttattaatggatttctatagtgatttttgatgcctttcaacatgtttttttaataaaaaaaatatttattcatttcttaaccaatacattaggacactagttatttgggatgactttatattatgtcaatgtaaaacaaagttatgtgacattgcacaaattttgagctaaatctaataatccagtatcaattcaagtttatgtgtatagagttgtttgtgtagcatacactttctttaaagggagtttttcaccaaacagaactattccacgtccacaccaccaccactttgagacatccccacataattggtatcccctttattaactctcaatagtaaatagtaatagaattaatgtgaaactgaattacatggaagatatggcaacaagacaataaactcaaacaaatgaagcacccttcattatcttagtttctcacttattattccttcaagtgatccaatgagacccactaatgacaccagaaagcaaataaagctgaaggtcctaaggacaatccattttctagaccaagcttcaattttcctctgcacaaagtacatctctaccgggaaatatatagccaatggccaaaagcctaaggctcctaacactcctataacttgattgaagtaaggaaataggatagcaagtccagtcgtggaaaccacataggctgttctaaaacatatcctgaaaatgtttagctgaaaagctggcaaccgaggcagtttcaattggtagaaattattcacaaatccactgttggggtatctttttgaacaccatctgtcaacagcaccatatatcggctgactgtaaatctgatcaaaagatcataaacaagaatcacaactatgatttgtctggtaacatgaaaagaattcagatattgttgcatatggacaagaattcatatagcttaatatttattattttattttttctaataaatgtcattggagcatttcataagctaagttaggaagctaactatttccagccaaacctttcctaataatgtattaatttagaacttctcttgtattagttgttttaatttcttccttatggtaactttacctgttacaattgtgctttcggtatgaataccatcatttctattaattttacattaagaaagaatgtagtagttcaattgattaataagaagttacagtcttaagtataaaatgtgaactttgatcagtagcactagtacctgatatcctccaaccaagtgaagaacaatgcaagcattcgcaaagtcaatgagccagtaaggctcgtaaaatccaaaccctgtcaagaggttccctggtgtttgatttccaaaagctgcatatccaaagcatccgcaacagaggtagaagaatgttgtaatgaggatagcaatcatggaggcctttttcatggtcttgttttctggtggaggagactctagagtgtccttcagtataaaaaaaaaaaaaaatcaatacttagcttcagctgtaaattgtgtcttcttttagagtttaatttctataaactgataatgaaaaaaaaaaaatgcaccgtcaactgataaaaaatcatgttaaatacaatttttaaaatagctattataacgtaaacaaacttactataaataacaatttgttattgaatcacaatataaaatatctttacagtttacttgtgagtgcatttaaattaaattctcctttacacgttcctctcccacccaattggaatatgaagggtacctgtatctcaaggaggatgactgtgtatggataggcaaaggcaatatcaccaattgcttggaagactaaccataacttgtcagcaatatttgaagccggtactcctgttaaactacccataattcttccattttctgcaaaagcaaccaaaagtctcatgatccattgttctctttccactccttgattctaagaaaatatcataatatagtttttttcttcatacataaattccacattccatatattttggcatttaatatgtttttagcagctacatttgtgttttagaataatagtacttgtttttttttccttcatcttgtttcttcaatgatcagaaggcttgaacggacaagtaaacaaaacattaaattctaattgtgaaaatgaaccttacctatgactgttgtgattccaagtccaagcccaatagatgagtatgtaaaggacattatagccgcaacaattgaaacccatgccatgttgtggagatctggtatgaatgacattatgacctgaactagtccaaacagcatcatatatactgcatccccatatttgcaaggagcctgatgcccttccttgtgataacaatttgatttcaatatcgctctgcattttgtagaaagaccaagcatcgttagaacatgaacacaaatatcattaaggtagactagtacctctaatattacatgagataaaaaaaaagcaacagatgatacaagtaacaaactactacacaaattcaaaattgcatatatacaatgatcttttcattttacatgggatttaacgggaattgtacctcaaacaggttgctgtggtaattacataagcagtactaaccccatacaagctcaaatattgaagggaaccagccaaccatgtccttttattgcctaaactaacagaaaacataattagttggcataaaatatggtagcatttcactggaaccatatcctgaatttgagactagagtgcttgtacaagaacaaggaactaccaagatagactctaacagcatccatgtaagagtagtttcttttcccagttacaggatccagagttctgtaacaatcggaaaggaggaatgaagaaacataggtgacaattgcacaaaaaagcaagcaaactggtcctgcaatccatcccaattgggaagtactccaagctaaagacagaacaccagcaccaataatggctgtgatgatatgagccacagcactccataaagttcctggtaaaattgatggaaggactaaaattcaggagtcaaattcatatatatgaatatggaatggtcctagagatttttaccggtccttttagcacgtccatcatcgtcataaccaccactaccacttctagttatttggagagatttttgaacagccatttttatccaagcatccaactcaattggtattcatggagttcagtgtaattgaattccgtatacagtctacagccaactacaatcaaaggaactatatggcagctacttgaattcaaaattatgtttgtttggtaactacataattttggtctgcatgtcacatgcttatgaaattaaaaaaggagatgacattttatatgaattttcaaaattgataaaggactcttctttgatgtctaggacaactctcctaaaattaagtaattgacgagcagcatagaagaagttgcaggaaatagtgtaaataaatctaaactatgctgataaacatgtgtgtctgtgccaaaccaaaattaaaatagctagtatcttaaaacttttggaagccatgttcttgataactaaggtatgtactaaaacagacattactagcgacaggacacagcataaaatcaggaaaactttattgtactagatttcattataaaaaatacaggccagaacatgatgtgtagaggaaagagattctttgaagtttgaagctgtatggtgtatgactgtggtagccttttaataaagatatgtactcgtcatcataactttctaataatggagctgtcgtgttcttgtggaatatattctctcaatgctcaacattgtgaaaatgattcagtaatcagtatctatcagatgaccagaggtacgtgagtgaaatagtggggttaatgtaggaagattcagaatatttgaaaatgtacaaaatagataatttagaaaacttacatattatgtttaacatcatgttgggtattgctcaccttagtcaacacaccaaatactccaacatcatctctttctggtagtttgtgtacaaactttatatacatcacaatacttcataccccaacctactacatattattagattgtttaagaccaccacatattcatagtctcctctaatttttaaacgtcacgtattcaaaattttcaatttatgaaaaataattaataatatttttttacatacatgtcacgtggagattaattaatgaaatgataatagtttttatccacctaataatttctcacacccacccccctcaaaaagagagagataagagtttgtcaattttcgcttttttcactatgcctctcccgtacgagaaggactctattatttgacagtcttcaacaaactaagtgaatgaatatttgaaattatattggttttgtccttgaagttgaaagcacgccaaacgtggaagaccagagtgttttatgctcctattttcaacacttgcttatcatacctatagcccattacgtgtagcttctttctatccaaggagcgtatggaaaatattggatttcatgaagaatatgtaggactagaataggttgcgtaaaatgaatgtatactggcaacatggttcaacccttccttatcacacctaagggctaaggcccactaccgtttagcttctttcacttcaagctcaaggaacgaagagaaaatttgtgattccattgaaaaatatgtagaatcattttgcgtaaaagcaccatctttattcagttgagtaatgtcttttgctactttaattgattggaatatcatttggctcatccttatcgtaagcaaggattgtgctaattttatgggactttgtgaacttcccatatgcaaagataaagtatatatagtcttttttgtgcagcacccacaaaggttacaccttattgacgcccgcacacagaacataaatgaagtccagccaaaattgccacagcaaaaaaccaatgtcatacatttttacccagctaataaattatgcccttcaccaattgccaataaatgctgcacttccaccagcacttattgcaccccaccactggattagcaatgtgctaaaggaaagtagatatgaattcctgttaaaataactggttaggttaaatgcttggaaatctctaggtaaatatattttgcggttgcctctcagactcagatggaccacctattaatcatcaaataaaggaaagtatatacgtattttatgccaaaatgtctacctcgctgaaccagaatttctcataaactgtagcctatgtagcaggttggacctgtgtcttttaactcaataggaataacgtctgttcaaaataacatatatactctccttcaaaaaaataacgtctgttgaagcccctagtttcaaaagttgcaatttggttctgatactctgttgatttagtagtagaagtgccatctggtgggaaaatgcaaggatgtcatattaagggcatgtatgttttcactttttgattttaaaaatgttttgcaaaacaagttcacagttaaaaagtttttttcaaaacaatttcacattattcatatattaaattttcatttaaaatctattacattttaaaaattgttttaaaatacttaataaaacttttagttaccaaaagttattggtccaagtaattttagactcggtttctttaagtaaaatttcggatgcggaccttgtggataaaaaataattacggtacttcgtaagattcaatttgcataattgaaatttgattgatcaaaaatataattaattctaatcttcgatttttatcttgtttaatttttcctcatttactcattgtgtcttccagacttccactatcctctactctaccaactttttttaaattattttttgaaaaccaaaaatatattttagaaattagaaatcaaacactccccaaattcaacccctagtatgcgtgttgcgttcaattgtacaaaaaaagattatagaatgaattaagtttttttttttttttaatcttttggttctggtgttgtcagtggttattacttactacaataaggcccagtttagttataagagaataacaagagatttgaattttctacctcccatcttgaatcatgtatctcccaaatttttaaaaatcacaaactacccttttcatattaaacctttttagaataggtattttataacaataaaaaatagttatggcttctagaataggtatttcataatcgtaaaaaataatttttaaaatagatgtttcataacaataaaaaataatgttacataatagtcaaaaataatggttgaaaataaaaaatattttatatattttgaaaaccctattctagaactcaatctgtgtttcagaattatcattccgactattatataactttcgaaattgtgtctttggaataatagttgaaaataaaaaatattttaaaatggtcgttccagaagacaaaacaccatgtttcggattacattcttacctttaatgatgatgtgcaatggaaggagggaggggaaggacgttgtgcgacattgtgacttgtgaggaggagatcacaaagctgccgtgaagaaggtgaaattgtgggagaagaagttgtcatcacgggagtaattcacacagagagggaagtgttagggttggagaagggtaatttgatattttcaaacaaaaataggaggatgtaagatacactactggaagtgcatgattcaaattccgaacaacagtctgcatgtaaacttcaaattgggctaggccgagcaagtattatggctagcccagcccgttaacggtaacttagcaaaagcaaacgtacagttagagccatgtccgaagattttcgaaaaacaaatataagaattgacccaaaaaatattttgactgaaaaaataaaagaaaaaggaaaacaagcacaagaggatttaccaagtgtgtgctctgtttaatgttgagtaatgtaaaatcactttaaatattagttaacgtgattataggcaaattttctaatgttcagtccggtgttgaagaattgattataagtttataatttactgagttaaaacaatttagatagttttgcgttagataaagaaaaatactgaattttagtactaatttgcttttagagtaaagatttttaaacataaagaaataactttacttcacaatcaattacaatcaaaaccaattttaaaatcatttttattcaaattaaatcaattttataaatgcttaccatttcttattttcacgtttcaacgttgatttgattaacagatacattttttctattatttctcaacttttctatttgaaaaagaaactctaccaaattaatgcaccaggttatatttcccccataatttccttatctatattaatcttcatttataaataaataaatacaaataaaaaatgactaaataaatgtctactatatgcatctaaactctaaagtttatatcacataataaattttattttttaatgttgcaggcattttgtcaaactttgacattattttagctatatgaagttgataaactctggtgttttatggtaattcaagagaaatcaaaggtatccaaacccaaatatgtatattacactcatcctaactcaccattagatataagtagaacagaaaataaagctatgccaaattaaaaacacatgcatggggttacctgatgcagtgatgcaccatataagcccgcatgcaccagcactccacacaccttttgcctcgtgtctcctaatttatcatatcataatatttcctattaatcataaaagtggaaataagcatggcatatataatagtgtttgatcactaacctaggtagaccttaacagcatcgatgtaggaggggcacctaatgttgccatattgaggatgagggaatctgtagcagtcagaaagaaggtttgctgaaagaaaggttgttcctgcaaagaaccctaactgtgccacagaccatgctagagacagcacccctgcccctatcacaccacttattatatgtaccactgccctctctacattacctaattcatgtcacatgtataaagaataatatatagttagaattttaattacctttctttcttttgaatatttgaatggtaagcatgatatatatatatatatatatatatatatatatataattaatgtcaattactatattcatctttaactttcatcacttggacataaaatttatgattaaaaaaatgtaacatggtaattaagaatattgatataaactccttcattaaaagtttgagaagtttttttttatcagttttattaaatatttttaattagttatacattttttaaataatacttgttacttaaatttctcaacaaacaccacactcattagaaaagacaaaggtgctaccaactgccattcacacaccagtcagtccaacaaatatctcactactgctattcaaattcaataccatctggctgcagagaaaattaatggcagaaattccaaggaggaagaagaaaagtaattccttttacatatacaaaagcattctgatgggagaaataaataaagctttcatattataaatgattaaaaacagatgtaataaccacttaccagttctcctaaatggcacgtcaagggaaggaaaagcttgaatcaatggagaatcatctgtttcttcctcactcatttttgtatcccttcaagcttgatcgatttgcttctcaaaaatcacacactcagggcccaagaattataatgaaaataattaaaagggtgtatgagtaagcatttttcgaaggcataacatatttatatatagacgcaagcaagcctctcaaataaacttcattcgaagatccacgagacacctaacccatgtttctgacctttctagtattcatgaatcttttttcatttttttctttcgatagcttgaaccttttttcatacaaccacgtaataagataatatgaatttagcgttgatctgttatagaaagtggaaacagcctttttacgcgaaaaatcataaaccacctacgtcgtagtgcccttttattccacgatataactcactaatactcgcaaaataaaataaaatattaaatttagttctagattattactgatgtattaaaaaaactatttatattttaaaaattaaataactgtgtccttatttacatgtaatagatgattgacttaactataaatataaaagtataaccaacttatttttctttagaagtatataaattacatgaaatcaatttatctgtgattaaaatttaaattaagatttaaaagcaatatacgtaaataaattttattaactcttttttgttcgccacatgtatccttcttcacattaatcttgtttgagatactctcaaatactgaatatatgagcagtagagatagtctcttttcctaaactcaactatgctagtaattttattaattgataacacaatttcattaaaaacaacattgaaagaaaaatgtatgtatattatgctatataataatatataatagtaaaactgttaaaggcttagacgaaagttcttaaatgttctttgtgattttaatgttgctttatggtatggtattttaaggccaatttagatcccagtagcataaagttgtgctgaataagatgttggatttgtgataaaaaaaataaattgcttccaatgcttttttaagatttctatatagtgataatggtgtaaagatattgtggtattgaactatgttgcgagcttgaatttggttagttataattctgaataaaccaactcaagtgtttagcgcttcattttcaaaatattcatttgaggtagcctccaccctggaaaaaccttggatatcatattattctttggtttaaggtttctagacagacaataatttaacggatcagttaaattacaaaaattttattctcttcctccaatcacaggttatactttttaatattatgtatctgttaattacataatcaacagatcggttgcatcatcatgaattttcatgcttcaaatgtacaaaacaaatacagaagattccaacagtggaaaattggacaaggagctcaacacaatttagcatggaaaaaatagtagtcacagattttatcaacttaaaaagcctaatccttgatgcaatataataccgggaaaccattagtgtgctttgacaacttgaggcagagatttgagaaggggcaaagagggtcttcgaactgtgtgattaagaagtaacataaatgtcagaagtgtcaaggctccagcctgatgtgcagtgcccagtgaaacaggtacatatgaaagaagcgttgaaattcctaaggtgacctgaaaccatgcaaaattaattacattatatactggatgacaacagcctctgggaaatcatatactagactactaacaaaaacaaacaccataaagtctttcttcctatttctattttatctatttatcatcatcatcttcatttagttaaagaatcagacaaaaacacgtggaataacaggtctgagtattcagttcgacaaaggaggcaatatatcgacaggcagagagctagctagaaacaacaatacaaaatgataattattataaagtatataaaactggaaattgaaattaagacctgaagagctgccatgccaacagcacctccaatcacagatcgtactgcaggatgtatctccagctttcttgttgaccaccataaaatggccacagaaatcagagttgcagttgcaagtatacggtgatcaagctgtcaagagcaatgcgaaacaccaattagaacttcatgttgttaaaactttggccgccaaaccacacttttgaggataaatttactactaaccaatccaacaataatggctcacaaagtgtttcaaaacatttcattcagttcaaatttctcaattcttgaaaagataataaaaatccatccaaaaaaaaatcaagaaaacaaaggtattattactatttaagcttttcagagatatcagcatggattacctgtacagttgatgtattctcaaagaaatttcgaatcagaggcttcatttcaaaaatgtcttccggtatccatgtatcacccatctttgggaaagtattaaaagcatgcccctgggaattaacatgtgagcagaatgattatctttatcctcaccaaaggctcaattatcatttcaagtataaatgtgaaaggcaagaaactattgaataagagaacatacagcatcatttccagcaacaaatgcacctgagacagcagtaagaccaacaagtacgctgataggcaatgcaagtctcctcactttagctgccccacgaacccatgttagcgattcagctggtggttcaggcataacaacagaaagtgcagtccagaagaggccacagtaaatagcaaatgctgatgtaagatgagctgcaagacgataagggcttacccttggctgagaatattcagatggtggctcctaaagaaataaaatgttattagaatctgacagggccggtcaatttaacttcaaataaagagaggaatttatattatttatgttccaacctctaaaccacttttgaccatccaccaaccaatgagaccctgtccagcacccagggcaaacagaacagagagtctcagtcctaatctcaacgtaatataccgcttatgaagaaaatatgaatatggcaaagcaaacataactcctagtgcccttccccacatacgatgtgcatattccatccaatagatgaatttgaattcttcaatcttcatgcctctgttaacactgccacaagcgcaaaactaattatcatcatgacattcataagaactactaagctctttgagaccaagtgtcaactcacttccacttaactaatcccttcccttgtttttcttgcaataaaaacacaatcagcactaaaaattgacctattcattcaattattctccatcactgtcatattaattatcatccccatactctgaaacacacaatcatgtcaatttttcttgcagcaaaaaagtttaaactattatttaaccgtgtaaattttatgacaaagtttgagaacagttatttaaaacattattcctaaatttttaatcatctgcttattatgatttgatttcaatcattaacaattagtcagccaacttcaagaagacttatttacatatgttaaggaatgagtatcttttctcgcagaaaaataaaaataaaaagtcccttggtgcatttcctaagttaatgggaaattaaaaaggtgtagcaagtgttttcagtttaccgcttgtactcaggtgactgcttatatttatcaaactcttgcaaccattcgtcatctgagaaaggagggagagtgccggtgaatttccaatcggtcattgaaagaccagatcgagtgagtctggttaaacccccaagcaccaccatgctgaacacccatgccgctgacccaaagagccatactccaaccaatttctgagcacgcgaacccccactcactagcagcttcaatccttctttttgttcagcagacaccatcttagaaaagttcctcatttgtggcacatgaacatgatgaccctaaataaaaagcatcatcccaacacaatttcctcagaactaactagatgtagtagtaactagtaactaatcattcacacataatagcatcatcatggaggaattaaaaaggaagaatagtgggtatttctgagaatgagatagagattaaagaattaggagtgattgtgaatataaaaagtaaaggaacagatgatgacccataagatcatacaagtttaaaagggataaaaattgaaaattgaagagtacccagatgagaaagtgaggtaaccttggggattagttgggatcggaaagcatgaatgtaatgggtggcgacgggaggggttaagaacttgaaaggtggtggttgggttgaagaagaagagaaaggcgttcctctaaggcttagcttgtgaattccgcatgcttctttgccgcgcttcaacactgaccacaccgttcccctaccaaacatctctgtttctctcctgcaaattgcaatgcaactttcagttcagggtttaaccaaggttttgttttgccaaacccaaactcaactactaaaacgcttattcccaccaccgacgtgtcgttttgtaggcctaaccattgtattgaaactccaatgttatagccttctatcctcaaatattattcatataatttttacacctttttctttcattgttgtacaaatttatttaaatataatttctcaaacaataattaaaaattaatcgggcaaattcatccttgaagacacaacttggtaagacgctcagaaattaatatttgaaagataaatttattatgcagattgacaaattgatctttaaactttacaacttaaattggttgtcaaaaaatataatattgtcaaattgatcatcgacaaatataatattgtcaaattcttaaacattagaacttaacgataaaatgatcttataaatttaagtaattaaatacgagattagtttgtcacactttttacatattcaaagactaaatttatattttttatttttgaagaactaatttgttcaaaaccaatttaactatttacccataattatataaataaaacacaagctggctgtggcctgtgggctggcctgttgccttattttcacttttttcttaaaaaatattacagtgttcttggttttagaactttgttcaggaagcgcttgattggtatttgattttcagcacttgatatcataatagcagcaccgatttcaatttagtaccataaatttatcagagtttatcgcagacttcttaaaaaattatccaatttatattctgaaggagcttattaatgaattttttggattagattttggagaatttgcatcaattttttttggtgtaaaggattagcaaaaagcccaacaacaaggaaacgcctaggctattgctagtaagctcggcattagtgcacttcaaaatgtttaaaatgtgattgatgacatttctagtgaatcactttggtattgtgtagtagggattgattgagcatttttagtttaatatttttctattcttcttagtttatttgacttctcttaaatttttattttctcattttaattcaatttttgtcttagacaaacaaaaggatttaattgctaattattatttattttcggattttatgctcacttgatctattttttttgtgcaggacctagaaagttctacagaacttcaaatgacacgtatgagtagtccctataaacaagggcggatctacgtataagagaaggggggcaagtgcccccccttaaattttgacataaaattaccataatactcctgtttttaaaaaaattcataaaaatatctaagaccaagaccacgagagagaccacgcgcgctcagtgactcagtccttttgcaagttctgctctgctctgtgctctccacgcgttctgctcctcctccgccactggcaggaccgccaccgtccaacgtcggccaccgccgaactccagagcctcctcgcgcaacatcggcacgggcgcacggcaacacctccgactctccgaggcttcgactccgagctgcatttcgcgcttccgtttctgggcttctgggctctggctgggttcttcaatcttcactgtcgggatcttattctaaggtctcgataatgccggaaagaccaccttacttcacatgctcaaagacgaggtttccctttccgatcccttttccgcttaagccctgaatcgctttaaatttactgggaatgttattcttttagttagaatccttttgtacaatttaaatattattacgaaattgagtgtttcaaagaagggttgcatggctaattgtctctaaatatatcctgtgcatgtttttaaatcccggttgtgttgtgattagcaatattatggaaaattgtggctgtggaccacaatttaaagtcaatcctgtgtatttgctgatgcagttgaggaagcctaaaaaactgcaatattgtgctcaaggttttaaaaaaatatgtgcaaccgcaatttcagcctcagtgtcaaggtttttggggtcattgtgattaatttttaaccatctgaatattgcatttgtatgcaatttttcataatatcaaggattacaaccatgaccacaatctaaaacctttattgcgttgcaattgtagttgtggtttgcaatttaaaatcaattatatgtattgacatgttttggtcttatgctttttttgtgtcatctaacaccaatttttttctttaaatgtgtttttctcaacaattattttctggttttagcaagcttaacaaattgatttcagatatgtactttgtaatctctaccttcgtgacattatcatagtttattggggctagaatatgcgcctggttattggtatttttttaaaatgagaattggcttggcagagactagttcaacatcagcctacacagtatccaacatcagaggagttgagtattgggaggatcaagtttaaagcttctgatcttgagggtcaccaaattgcacgaagagtctggaaatattactatgctaagttctccctctcctaacacagacacacatttgtgcatatatttatgaagtgcaccctaacagttgacttctcaactctgttttgcacctttgaaagcatcacttgatggaacttggctatatacctataagatttgtttggaatttaggattaaatcttactcctcaatctgatacagttttagacttttggtctacatgctaatattaatgtgtggtttgacttggaatatgtgaattttccgttctagctgttaacaaggataaagtttggtgtgtgcatcatggcttttaagaaattacatgaatatttggaatgatttggaacttgaaatgtgactatttttttctttttattttttgaattgttgatgcaatgatgctgatctaccacctgcagactgcagttttgctgcctttgttgttcggattttcagccacgaccacgaccacttcctattcgtacggtaagaacgcttttttatttattttccgttataatcttccaaatattgagtgccctccctcattaattttctggatccgccactgcctgtaaagataagaaaaagatctacaattttgtcagagataagctaaggtcaattctgtcattttgagggtcatttgaggcttgaaagtcagaagctctgcacttgaattttggactgcgagttacatttttaatggtgtaattagcataattctagtgaaacactttggcattgtgtagtagggatctcatatcacaaaagaaaaaaatgaactcatttggtggtctatttggtggtgctcaaaaggccaaaaacatgcctttgccttgcatttgctctcttaatcttggtactggacttctgttttctttcacaggtgcaagaatggagacaaaaagctctttcatctttttctgcagtctatcaagctatatcagaaaaaaaaaaaaaaaaaaaaggtgcaaggattgttctacttataatgaatttagtttggagataaactggtttgctaagcatagttaaggcctattttattagtaattttgattctttaatttatatacttttaccctagactcatgccaccattatgtgaagctggaattccaagggtgtgctatcattgaatctttagtatcaatacttgcttgcatataaatcaggcttacatagaggaaatatttggtgctttgtttaacatttgtctcctgctgcagagtccttaggtttgttcagaagtacttgttaaattgagaggattcattcagagttctagaccaacccaacaaggacctgctgtcaatgtagatttctcagtaactgctttcaatgagagcatatcagcataggagttccatacttgcagaaacgccttgagtaatatttgcagtggagcataaaaaaattgaagacatgtaatctttgaatttatcaaatcaattaattctccatttaaaggatacgcgggctaatcataatgcatttctatccgtatatttcttttctagcttaacgaaactacaatgaacttcttagaaatgaggcaaaatgaaactaaagagcaaccaattcatactgtatgggccaattcatactgtatggcaaacgatgcaaaggctgcatttacattctgctcaagtatatcacaaaaaataggtagagaacttcgtgatattcattcattgcttctggttattccttacagggaacctaacatttcctgctattgctctacatacactcatcatattgttgcgaactatggatacactatcaagtctataactctaaaccccttcatctagagacaaagtctctgattcaaaaatcaatagaaatgctccattggtataactctttctcaggtactctcaaatcaatagtcaccaatccagattcttcctcatacttgaattctacttcttctgaatcaactattatcaacttaggctgagctgatgaataagcaccaaattggccacaaccacggactttcatggctatatttgtactttcattagatccccaactaaactcttggacagcccctcctgaattgaacatatttattaaaccaataggagcaaatttgacaccattgctcaattccttcacgggaactattgtgaaaacttcatattctctggttttcaaggtaactgggatggatgcatcctttggaaggtaaaccacttctcctgcaaattgacatcataaaaagaccattacacaaaagaaaatttgggttaaattttgtaatctttacaagtatcattgtcaagccgaaaaacataccaccaagatgggaataaataatggcatctcctgtccatttatcatctgctaccctggataaatagtcaacatctttagccctaatgacacctgtgacaatgcctggattctcatcgtggataaggttcttcttgccaactttgcaccacccagctccttggcaattgaataccgcaacaactccagaaaaatcattcatgttccaaatcttcagaagactgcaaaagcagcatacaaggagttaagtaaaatacaaatataaagaagcatgcatactatattttgtagtagagtgtaaagagtaagatactacatcaattggtcaagtatataactatataggtagccaaatcattttggattctttacctctttccatctctggcaggatcagtaaataagcaatcctttgttggtcgtcctggaagtttagcccttaatatagaaccatcaggtagtgcaagcttcttcaaaagaccaaagtcatggtgtccgggcttgtcactgcacaatagaacaacatccaaaggtaagacatcatttatcaaataaaaaagtactgaaaaaaaaaattactacaagctctactcacctgacataaattggacatccccctacagctcgtgctgcaccatgatattcagccattggatgtaggctctgcatattgcacaagaagttaattagctcctgcagaagcaagttcatattttttttcatgaaaaaagaaggaaggatcctgtatttggtaacttacctgaaacatatcccagtctggctgcataaattcaccaaggaaaatagtattgtaagccactgatgcaatgtgaatcgtgtgggatgcagggtctcttggccagaaatcatctgatgccctaataacagctgaacgctttgcgctacacaagtaaatttataaagaaaatcatcatcatgaataaaaaaaatctattgttattgtgttaataaaagcattcactgaagttttataagcaatccatacctgtataatccatctgtgttgtgactcatgcaacaaatgattccattgtcagggaagttcctagcgattgatgcctccaatgcctggtggtatttccttgcaagtttcaccctcccaccatgtcctgctccaagagtttcaaggatattctgaacatcaactttgacaccatcaataccagcagatgccaaatatgagtggagttcatcgtaaaaatgaaaaactttctcaggattcacaaggccgagcccattgatggcaattgttgtcaaagcttcatctggttgatttgactcaactccaggagatgagatagggaaggccatctttgattcgtagtgctccatgcccggaaccccgggtttaacacctccccaatatcctgttattgcatgccacacatatacatgcctgggaaagattttccaaagatgatcatgagtactatgtgtgaactgaatatcttatggagaaatagaaacaataaaatgaaaatggcaatactttatattatgctctagtttgatttcattggtcatatgacgaagtcccaaagccgggtcctctactcgctgaccttccttgccatctttctggaatttgtgattctctttgatgtttgttaagcgatttgcaaagctattggacaagaaagcacaaaaatgaactgattcaacaatgtaaaatggatggaattacaatttgataatgaaacttagaaaggaagtacccacttggctgaactatcagatttccattcaacaccattggggtccatcccaacagattgccatccatcatcaattataacaaacttagcaggaattccacctttctcaaagctgcaaaaataaaaataaaaatgtaacagtcacaaatttatgtgatgcggcatatctcataactatgtccattgtccatggaaggaagtaccacctctgcaatccttgcttcacattctctgaagtgacattagtgtagaaagcatcccatgtacaccatccaaaccagttcaacatatctggcatctgaatataagtgggggggaaagtaaaattagaggtagtgaactttaagatgcagtgctcagaaataagactgtctatggaatttccattttagggagggagaagctatgtaccttctttcgctcgcgatgtgcaaaggtctgtaagtgtttctcaacagtcctaaaaaaaattgcaaaaaattaaaataaaatcaataacttgacttgtttagacatataaaacactgcacatccaaacgtgcagttatgttaaaacaaaaatattacttcagaagattaaactcaatttttgtaataactaaaagtcaatgatcccaacccgaaagccttacttatagatttcgatgactggtataaactaaaaattagggaacaacatagatgaaatttattgaaaggtggtaactcacttgacagaatttgttatgacttcaaaagggtcggatccaaccccaatataaaccaaatgagtcccatcaaattcttccacagcaggacaacctgaaatcagatacaaatttcatcactttgcacaacagcaaaaaaatccccacatatatgcgaataaactaatgaattttttcttcttctgaagatcacataccactttccacacagatttcaatctcgtcttgatcattcccctgaagaactgctctgaaatctccttccagaaggggtaagaaaactgcataggtagcagcaccttggtctcctcctccttcaatatcagagccactgtgtgcttcaacaagcaagaactgcgtctcaatggggatttcttgtccgcaagtgcccattctctgcgtcatccaccacatcttgaaccggaaaacacacataaatcgcaaccccctgaaaaaaaaaaaacatcatcctaggatcagaattgcagtatcctaaaataaatattattaactatgcaccaacacacactataagaaacatcaaaagcaatccagtacatgcacatgcacttcctgattgtgacaagcaacaacaaaaaatacagcattcacccaaaattacaaagattttatttttcaccaacaagaagaagaagaaaagaattgaaaagagaaaagtgaagagtacatactgaagcttgccaattgggaagactgtgcggctacccttgtgatgggattgaaccccgatgaatgccccattgagcaaagcaccaccacatgcaggggaaacaagaaccttgtcatggacatggctcagcactttgttccccaacaccatcaagttcccatctgcaacagatattcctgcccctacagtcatctttgatgatttgatgaatcaaacacaagctcaaaaggaaattgcagcacacagagcactgcaaccgctctactgttgtttgttccaaatcaaatccaaatgagtcaatgcagcatgggaaggagagggaagggtatttatagcaacaggataatgataatatcacgtaaagctgtgtcagcagggtgcccaatttgttaggaactattgccattattgatccataatttatgaattatcaacaccatgcaatcaatctagccactcccagactaaagtctctctcttttaagaaaatttgctgctacaaatattcatgtggacatatcttatatttatcatttatttacaacatactttgtatttatttatttttgtcttttgtggttaaaacttaaaagatcggctaatcagaaaggtaagacattcaaaaacttaaggacattgcaataacacatctttcaagtttcaatgacaatcttttttcattatttaaatagtgcaccgattaatcttttgttattacattacacgtctcttatttattatagattcgtattgcaaattgcactattatacaattcgtaaaatatagtaattgacataaattatctctccaattattgattaagaggcatagatattttgtttttaaaatcgtacttctttatgtataaataatacagtgctatctttttttaatgaataaactaaaataaataagtaaacataaacaataaataaacttacggtaattattctccgaaaaggaaaagaaaataaactttatcagcacacgtgaaagcacaggaaattgtgtgtgggggccacaataatgatacttgagatttgagagtcgttgattcgcagagtggatatgataaggccattgaggtgtaggtggagtgacgcaagggcgaagcagcatatcacaatcagtggaagaaaaatctatgcgtcgtgagtggtgaaatgacctacgtggcatatagaagatggggtccacgtgacgcctatttcaagaaaaatcgtttttgatcagacaaaaaaatccggtaatcgggtgaaaggcgatgaatgatctacaacgaaggcacacgtgaaccctatggagtggcgtcagtttctctgatattttatagtgcaatttgacttgaggctctgctgtgcatgcatttcacttcaattcattcaatgtctttgcatcctacattgattttttttatgcaacatgttagattcattaaacaaataaaaataagaataaatggattatgaatttacattgtaaagtagtagattttagtttatattatttaatcacaaattatatataataaatttactaattttataatattatttttaaaagtcatgaataataatttctaattaataatataaaaactattttatattttatattgtgaatacatgactaaattctaaaataattgagcaatgaaaatacaggaatggttcatgtttacaaaaacgagtagtatgacatcactcagaacaatatgcatgccagtgacgtggatgataagattacaactcgttcacagctcagatctgacttggcatttgtttcctaaaatttaattgcatagattaaaagactaggcactaacaagtgtaaaaaaattagaaaaaaagactatcatctaataaaaaattataacgtgggataaatttcttaatttttataatatttgttttacaaattatattaataatgattttataaatttattattaaaataatagaaaattattttatattatctatagttaatcattaaactttattttttattttaaaaaaaataaagaattagatatttttcccattatattttttaatgaaatttcatatcttccctttacttttttctctctcttaaactaacagaatatagataaataataaacattaagaagttatcaccaaataccaaattagttggatttattatctaaacattcaaataatgagcgatcaccccaataaaaaacttcaaatacaaaggacttgaacaattaaattttttaaattatctcttagtattctttattaaataaaaatattaaacattttttaatatttttttataatattgaaattaaaaatatataaaaggatacaatattgtaaaaattgtaattgtaatagtaaatttagttattttgaagcttactccattaaacccgaacattgcgacgctttcacattattagccgtaatattgttcacctgaactaaaattatttcatttcagccatttatttataacatgagttaatcaaccactgaacaaaagttgattgagtaaaaagtaaaaacttaaatggaaaatattcggctatgaaattataagtttagttttttataattttaattttatgattttgatttctttatttataaatcaaagtaacttaattttatgtgttttcataaaagataataaattactgagataaatattttatttagttaattttataaatattttatatgagttactactaaagagttattttttttttccaacaagtcattggctcatttcttttagacaacttctcgagtttaagttttctggatgaaaaaaatgtagttgagaaaggagacttcaataaaggtgatcagttaggtttctcaatcgagatttgccattaataaaattagtagatacttcacacaaatatcatagtaattaaaaaaattattattttttagaactataaaaatttataaattaaaaaaaattaatatataaatatttttaagtttatttaatacaattttatttttattttatcaatttcacaaattaatatatatgttattttcaaaaaatattttgtaaatatatttttatgtaaaaattatttttaatatagttatataaatcaatataattgcatcagttaatatttaaattatataagttaactaaatttattttaataagtaaatctttttatttaaattatgcaaatttatttttatatataaataatacaaatatcttaattataaaaattaataaatttttaatttttttagattatttgaatattattttaaatttatgtaatttgtataaattatataaaataatttttaaaatgatatatatattaattatgtaattttaaaaaatattataattaaacaagaataattttttatatataataatttattaatttatattaaaataaaatcttatgagaaaaataaatacataaaattaaatgttaaatactttattttaatatacaatttttatgattttaaaaaattaatagctcttgactaattatatatgtaaaagaatatttatataactgactaaacaaagtaagtgtcttaataatttatttttttggtttttatataaaagattatgtgttcaatttctacttttattttttactttatttaatcctttgtcacataagcgttgagttaacggtctaaataagatgattaaatgtatttagagactgaattcacgaatgcaaattatagaaaacaaaaataacaatttaaccttaacttatcaaatatttatttgtacttaatgcttcttttctaagttaaactactttttaagttttctaagtcaaataattaatctttgttaaaaaaatgagagaattctgagtcaaatttcattttccctttcctttccttttcaagcgttgaacgacaaatttgataaattctcaatatttgatcatcgctcacatgagcaaaaaaagtagaattaatcgcattacaaatactcacctcttgcacttatttaatcatacttccaaactctacacagcacacgctcacatatacattgtctctaatttccttgatacaatttttttcccttttctccttttatttttgttcatgttccaactttttgtcatggagttcatatatcatgatttccaaaaccaaagaactccatctccaatatcacaccctttttccacaattgcctacatttctagatgcttattataaggtaacacttgtttttcttcacgttcctctcaagtgatccatttgtgttcatgtgttgttatttaaaaaaaaaaaaagtttggtaacactagtttatttataggttgtgcgttcgcaccaagtgattttcctgtcaatgtttcaacacctagtgtttttccaatgtcaatgttgattaatgtcgatgaagcatttcaacgagagttgaagaatgaacaaatatgatgatagctggagaatgatattcgttgacgagatgacattagtctgacaaaaagagttataagagaaaattatgaggaaaacgaggtcggagaaggcgttaggcatctcaatgcaaagacaagaggcaatcttggccccaaaatgaattttgatgtctttgaatcaagattgttggggtaagaactctaacacatttggtgttccaatatataagtggtcaacaatataatgcacagacttaaagggatcaaatgatcacactagttagtgtataattacgtatcccaatgtctggaggcttcacactatgcataggtaagggagaaagatattgtatacagtcttatctttgcatatgcaaaaaagttattttcagatttgaactcatgatcaacaagtcacaaaaatacaactttatcgctgtgaatgttgatgcaaagcgcaaaatagtgacacttcgtgtcgttgataactatgagcatttgttcaattagtttacagaagaaattttagcaagagtggggttgcacgctatgtcaaattactgtgaaaagtgagaaaggattaaatgatcatttttcacagaaaaaataaaaggctcaagaaacatccctgaaaactaaaaagaataggcaaggacataaaaaacattattatggttaaatgaaaattaaaaaaaaaagtgtgttaaatctaatgaatttgttgttcacatgaattcaggattgggttcaagtcttgattgttagacatttcaacaatggcggtgcttgagataaaagtttggaagtgtctaaataattaagattataatatatttcattttgatgtagatttttatctttaatttttattatggggcgtaaaatgtacatctactagttggcgagaccttatgatgtatgagatgtctattttgtaaaaataattaattatttttacattgtaacccatttataaaaattaataaatattgtatacaataaactatataaataatataaattgattatattcttgtctaaccttcaatgttatttttaaaatatttgtacaaattattgaatttttattgattttaggaaaaaaaaatcccatgatagatcgccttataatttagcatttttatttttttgtctttgtaatttattttaatttcatatttttttatgtttcgtccttaaaacaatttaaataatgctttaaataatgaaaaatattatttaaatcacctaaatgacaaaaaacaaacataatttaaaatgactaaaaccatttttatcaagttagtagaacaaaaaatgtttaattacaaaaatttaaaaagtatttaaaccatattattattattgtaattttacatatttttttaaaaaaacttattactttttggtgttgaaactgtaattttacaatgtgccactcaatgactgaccaattcaaatatttaaattttgtgattatataacccaaagcctgaacatttatatgatttaaaaagaccgcacatttataataacacttactttaacacaagtagtgcccagtcaagttaagaacaccaccttacaacagaatatgcaaataagagcaaaggtgtaccaaaaagaaaaaacaaagcaacccatgcatctaacaggttctcgcatctgtgcatactagcttattagttagagacaattaatcagttagatgaaattaatataatcttatagtatttgctgacattttaggacaaaggctatctattcaagggtatcatctgatgagtgttggagtaaaggacgagggtgtcacaataatttgaaatgttgcatggacaacgcgagacaagagttaggagaaaaatagttgtcaaatagagatagagctgccacatgcctcaattgggtgatacttcaaaattaatctctcaaataggaatccgtacacccacattgacttttttgtgcatgattattatgctagattaatgcttctgatatatgtgatttcgtcgctggcaatgcaacttgtggaatttaatttaatttcaaaaccaaaatgaatcaagatttgactcgtggatactgaatgtgaatgacttataatcttataccaaatttatattagaataaagagaacttcccttcacctttttgttttttgtttttctaacaaaaatagttaccgtatacgtacctatttggtgagtagtacacggttcttctctgttaagcaactgggtttttttattttttattttatcagcgttaagctactggattagtgaattatatgagcacattcaccaaaaaaaaaaaaaaaaaaagtgaattatatgagcacgttgattgtgatttaccagactaatcatgtcaacgacgcccacagtaattgagaaagtgtcccggttctgtgctgggctacctcactcttctaacttctgcagttgaattttcaactgcatcacaataagttaaaaattattcactgctagattcaaaactgcatgtacccgttggtccatttgaactgccagtgatcttgatccctagtgaattatcaatttaaatccccttttcccttttttagctggcgccaaaattaatttagtacttaaacatgctgatttttttctcaactcgtattagttacgatgccaaaaacttttccttctatatcactattctgaaagataacatcatatcttctgtgagagaaatgacaattacattttttttataattgacaaaaatttattgaaaattatcaattttggtgaaatttatttattatttaatgattatttctctttacttaaatgttgaatccaccaaaattgataataattaataaaaaatgttaatcacagagaaaatattgagaagaaaatgttacacaaaatatcattaacatttttctactttatgaatataagatcagtttagtgttattcttcccctttatgctcaacaacttaaatgttcaacttttaatatgctattaaagatttaaattgtttaacactgttgtacattagatggatcaatctatataatgagtacattaattgcaattttaggtgctaatggcgaacaaaatttgcaagtcaaaaagatttgtcaactatataactcaaaaccttggtagctatgccttttattatattttatcggtacattcttggtgatagcatgaaaaaggcataaggactgccatataatttgcaggtgcaatatatgaacgcaaagcacctgccaattaaacagaaaaagaaaaatattgcacaatcttgaattcaaatacgaattttaaatatcattattcaacataaattgactcctgagattcagtggctatcagcctatcacgcggaatcaaacttcaacttcgttcataaaaaaaaaattaattataatttttgtatctccttttttatatttatttcacctccacgactcactttattttattttccctggttttgtcgtacccacacgcatctcattttccttaacacgttgcgaaaaaacaattattctaaaactttctccactaaaaaaagacgacgtggtggggcagcttctagaaccttttgcaaacccaagacgaagttgttattgtgcaccaacaccaatacctgctgccatttaaatgaccactatacccttctctcaatcttgtgctattctccatctttgaccgccatataaaaacctctctcaactctcatttcactgcacaaaacaaagctaaattcaaccaaccacaacaacaaacgcaacattttcatttcccattatacccctcatcgcagaagacctcagaaaatatctcaatggcgggaaccctaaatctcacgcctctcaccggtgccggcaggactctccggccaccggtaaggatctcaattcgggcattcacggcgacggcgatcgattcccggcgagcggcgagcctctacgaggtgctccggatcaagcagaacgcttcggcggtggagataaagtcggcataccggaaccttgcgaaggtgtatcaccctgattcggcgctccgtcggtcggaatcggacgaacgggacttcatcaagatccacgacgcttacgagacgctgtcggatccgtcggcgagagcactgtatgatctgtcgttgatggcggcgcttgatggtaatcgctcgttgtcgtctgtggtggctgctccgaatggctcttccggattctactatcagacccgtaagtgggaaacggaccaatgctggtagatagcttccaagtagaagaaaaaaaaaaaacgagaaaatatattttctgacattaacaaatttacacggaaaaaaaaattaaaatgtagaaacgaaaacaaaaaaacgattctgtaaattctgtctcatttttatgtagtgctgctcccaggtcattttgtccatttcgtttgggagaaatttctgctgcaatttcacaaccatacgtctatcggccaccaaaaaactttccgtcgacttaaaaacaattaaaatataaacacttttggacctttgccacaaaatgtattacgaagtcaaagtacaaactaagattttttttttttttaaatagtcattttcatattcatcaatatgagaattaacaattttattataatgaaaatttaaattttaatatttgaaagcgaaaaaagtgtaatttttgattggttattattaatgaaagagattaagtaatacatttaaggagtgctttatatattcatagaccaaaataattatttatttaaaatataatttaattttcatctttttataatttatttgttgttttaaaatttttattgtgataatattataaagtaataaaatcaagttgagttttatttttttaggattaatgtaactactatacatttttgtttgagtctcatattttgtactataatattagaaatttcaaaacaataaataaattatacttattaatcaatattatgtttattattatgtttgttctaacatgttttttattaaagtatttattgtaatagtatgattgtaataattaaacaaaaaggagagaatatgagattaaattatattttagataaatattcattttcgtcttgaatatgtaaagcgttgacaatctcgtatatgaatgtgtcaaataaatttttggggactaaaatttaaatttttatcttttaagaatgaatttatcaatattatatatatttagggataaaaataaatatgaatatgttagatgatataaattataaaaaaaacagatacaaagaaaaatggtgtcaatgtaatgtatatactaatattataatgtatcatcactttatgaatgataatatattttactcgtataatatattaccttgttagtttagattagtgaagcttgtgattttgaactattttcacaaaacttcattaattttgtgattaagatgacttattagcgatttaaatagcctaaataatacatttctagtaattaaaaaaacacggagaaataattgaaaataattattagttcattagaagtattctattctatacacattatgtgggaaccgatttgtcctactgtttcttgcaattgttttttcttttttccttcttatttattttttatttttttagaagtattattagtattactgccatgttagcatctgatatacttggtcaaaggttggtcgtcgcatgaaccatttttatggatgtatcattgctaacattacaagcaaactgctgcagaagtaaaagcacccttccttggctcaaaggaagaggaatccagagagaataatagtccatgatcaaaatatttatataactatgagaaagttcaaacgagagaaaaacacagagcaatactaataatcacaagagcttaaactgttaatattgaatattaccaggcttgaatttttttatttcggcgttggaaaactcagtggatcatgtttttgggtcaagagtaggcttaacctgttttgactacagttgtttcattttacgtagcaagcccatattttatgggcccatataataatatttcagctactggcattagtgtccaaaagcaattagacaagaaaaagaaaccacggccattagttaatactactagttatgttgattgttgggaaaggtgcgttaaattttcaatgcactttttattaaataaatattacacaaatcttaataaacgaaattttattcaaataaattaataaaactcgcattaaacaaatttaatagcaaaaatactaattgtttttcataaatgattggagagagaataattaagtaaagatataaaagaaaaaataattaattcatttaaaaaatatttttttataaaatagataaataaatttttgaaaaattcttataactaaaaacggaagtaataaataatacgtttgtgactactttgttgatgttaatactagattataaaaactggaattgatgattggaaatggaagaaagagacgttaaagtatagcatatgggggattaagtaagtggttagtatctttcagtattaacaacggtcaacttcagcgtatggaccaatcaccaaatttgtagcctcccaaagcttcttgttgtaacggactcaaccacttcaccactctcctttaacgcatcaccttccacgtttcccatgaaacttggcaacaaaacgttcacgttttcgtttttatttatttattataacaatgttattttttaaaagaagaaatattgatgatttcataaaataatcctcacttatacatatttaaacattgtataaattacaaaatagttatcaaaacattttttaagatattgaattcgaataataataaaaaaaacaaaaacagaagcctaaataattttcactctccagatgaatctattcaaattaacttaaattagtggttttttatgcttgttaaataattccctcatccatataacagttgaaactgaatatcaaaagttaattctaaatatatgtattttgtcttgaaaatttaaatatgttcctacactagttactatcttataattttaaatacatggaatgaattatcggttttacttatgtgatatggggcatctaaaaagttgagaaaaagataaatttcttttgttccttttattttattaaagggaatcttgttttaatggattagatagctttccttataagtgaacaaaagcgtcaaatcaaaacgtcttgaattggtgaaagagacaccaatgttgcctccccttccttctatttaccacttttacacttctttctatttcccttttcttttaaattccgcattatctttctcaattttcccaccacctcccgaacagaatcagcacccgaatttcccagatccgagatacccagaaggaaaagattaaaactttggttttttcatcgatctctggggaaagatgtgttgtggggggagagtttgcatgctttgcacgtgtctggttctggtggtgatcgccatcgggttggtattcgggttcggagtcttcaagcatggattccacaagatcaaagacactgttagtttctgcgattcttgcggcggcggcggaggaaggcctttcatcggttatgcaccgccgccattgttctagttcacagcatcctcttgttctatttccttcttgttaattgttctggggatttgtttgtttcttttttataaattagcattcgttagcgttcatatttgtaattacctgtttcttgggattcatgtttgatttaatattcatttgcctttgttacaatgctgtcactattttatctgtttcttttcggggtttcgagtttggttttataattagcgaattgcagaatccatgtttagaaaaaaaagtaatatttttcatcaattaattatttgaagaaaaagctcaatgcttttctaattatttttctttggaaataattatgttaacatatagtaattgaaaagtcattttgttttaccaatttttgtcatcacgttaatcatttgctgttcattcaaattttaaataaatagctttttcttttttgacagcattaaataaatagcttttgtttcctaatttttgaaacatcttattgtctaactaacaaattgatgatacatcaaaggggtaaatgccgatatttgaactatatttagttcataaatttgatttttatctgaatgtataatcaaattcagaccatcaatatgtacccaaaaaaaatcaaaccatcaatatatagttatatactattgaatctcaatgaattagcccgaagtgagagcaagagattcgagagaaatggatatggataaggattcggattgcatcgcacttcttatgtgaggatgaagattttcaacattaatagaaaaaagaattacgtggttatgtctctctgtttgagtcgtgctccacatgtatagactctctggttaaatcataaaaaagaaatgctctttggttaaagtgggttttgcttgtgatggttttctacttgacttgccccctaatattcgtactttgcgtgtttgacataattgattaatcaaacatgcttgattaatggtttgaatcattttaaccactacgcttgttgatactagtatgttttttttgcccccagaatatcctctccaaagcggcgacatattgttcggatgttatcactttttttttgcgtagagaaaccaaatgcaattaattctagagaacaagaaaaatagtttattcttccttatttcatttcttttgaggggcatttcctcctgtatatctggcactagctatcctatcgctgataatgtagaattttttctacaactcagataaaaaggtatatatacattcttataaatcagatttttcataaattttaaaataaattatgtgatttatcattaattttaatggtaatgttgatgtagtttagttttggtcgtaagaaaacaaggggccacaaaggcctagagaaaaaggaaggaaaggataaggcgacccaacccaagagttataatcaattacaatccttaagcccaaatctgaatagccgaaaataagggtgtgccatggaccaaaagaaaagcttgggaaaatgcagcttggataagtttgagtgaagctggacttggattcttttagtaagattttggatatacaaaaacatgatttaaatataaaaaataacatggtttaacttgaataattggaaaagcctctgaatacacaaagcaaaaagatagggaaaaataggagcatcctatctaatacctagcatgggatcaaactcctggagtagctctccattccataacattttcatactgggggaacaaatacaattccaaagaatatcaataaacttggccgggcaaccaatgtcatacaaagtatcattcccaaactcccatttcaagcgttcatagactttctccaaatcaattttaatgactattcaccccttagctcccttcttctttctcatagaatgaaaaatttcttgagcaatcacaatattatcagtactctatctattgggaatgaagttgcagtaatacgggcagatatatctttccataaaaggcctcaaacaatgagccaaaatctgtaattattttacaggagacattacaaagactaattaaccacgtgctccactttaagaataagagtaataagagtttcattaacctcagcaatgacatttggatcatcaaaagccttctgaatcatacttaccacatctctcccaactactccccactcactaattttcttttacatctgcatcactgtgaagaatgaaaaggtaaacaatcaaatcataaatcgtttagatatctgcattaattattaattaaagaataaagtttattgaaatttaacggaataacatacatacataaataccaattccatgcgccaatgttgaaagggttggatttgcggattgtggaagacgagcacatgtagtttccactctgtatgctgcatagcataatcgttgttcatcctttccttcctatgatatgaatcatatgataagtgttgaatgtcttatactttatccaaaaatgttagtattgttatattatttcacctttcctccctcactctcactctgtttctctcagtaggtattaaaatatatataaataaaaaaatcaactcaactcaaatcaattgaactaaactaatatctagggacggcctgtgcctaggttcaagacccgttgctggaaggaaaataaaactgtttagggaaaggacacacatttttatgtattttttttgaaaaataagaatttaaaacttttgataatgatgtgagtttatccaatattaaaacataagaatatcagatttttttttcatttcctttatctcataaaagacatacatttttataatgaaaatccaaatcttttcttgaactataatgtgttatatttctataacaaaaataatatcatgcgttagacagcgggggaaaattactcttaagtaggataaattgatgatacacaacttcagaataaggacatcaccaacaaagagggatttaggtttaaaaaaagaagatgtaaaaaagccaaaggtaattttgaatgagatatatggaatataattatcacatttaaaaattggtcaattcaaacaataaaacctaataaaatattacttcgattcacgctactttctttcactttctatcaacattcgaagcaaagcctactcgttaatacgatgtggacaaagacttagactttgtggaacataattcttcttgtgatcaacgttaacttttagttctaatttccaggtatattcaacgaaaggtttcaaaccacatgttccatgcataacagtcatggaacattggaacgtaacccaggagaccttggcgataattgccccacaagaagaatgaatcaccattcaccaatgatcgataatatccaatgaaaaacagcttcactttacaaaaaggaattatcaattatgttattgagacaataaatctttaaatttaattttaatatatataatgttagcatagaaaattaccatgttatgataagaaaaatcatgttattgatttaataatgtatcattaaactcattaaataatgtggtaacacattgttgaataacaatattataaattttgtatactttttcttttttgttgacaaacaagggattgaggcacccctggaagaagattaatatacttattaatttaagattgcaataaatataatttttaaaaaataatatacttattaattaccgtacttaattaaatttcagcatcattattctcttgtatttcgctatttacttaatcataaaaaaagaaggaaaaatgacatgaaagaaaagaagattgggcagagtatttatgcggataagccaagaaaaatgaagagcctgagggagtaggctcagacgaatgcactaaccaattgtaaatcgtaaaggaacaatatcattatattcagcaatttaatcttaaattattttcagcaatttaattctaaaatctattaacttttctttcaaaattttaattttaaaaacttataaattatttctaaaattttaattttacaatgtatcaaatcacttggaaaaatgcaatcctgaagtagtttataaagtacttttgaaaatgagtttacaaatcacttctagaataaaattctagaaaaaagttcaacatatcttaaaattaaaataaaaaacaattacatgctaatcttaaaaccattatgaatggaaaaaaaatttctccgagtatttaatataatcgaatattcactcataaaaataataattgtattttcataactcaaactcaatattttttattaagttaaaaaaatctggtgtcaattaactcacgtgatcgatgattacttttttgtaattaagacaatacaatctcaaatgtttataataataactatcagttatgcttaactagaaatatttttttttttttgcttattcaatttataaaatcaaagaagacaaatatcaaacacatattatgttaaaatgtaatctttccattgtcattttgaagttaaattaacacattttgaatttttatgttgacttcaacatttcattaaactcgttattaaaataccaaagtctatgaatcaatataaagatgcatcaatatgtttttttgtgatttcttggttaatatatatatatatatatatatatatatatgttttctcttgtaagttgaaaagttcttctcatctcaataacttatgtgtatgatactacctctttttatttatttataaaaaaacaaactatagtgtaaaaataacaggagtaatagtaattataactttttaagatttcttaaacaagtacctattgtgaatgaattttttataattctcaaaatcgcatctcttaaaaattaaggtgacacacttaccattagtcagaacacttcatttgtcaatttcttgcatctcagaattatacacttaaattcattaattgtcaaatagtttaactcagcaaaatagaatgtaaattgttgtaaacttttaatacttatttgtctttgatttctattttctactaataaaaaaaataataattagtagttaattacaagtatgaaattgacactcccaaccgaatctggcccaaatgtggttttgatgaatcgagtaggcggcgatttggtcggttctagctttctaggaaatggggaagtctaggaagagaccatcatttgtggagggagaagatttttttttttcatggtaatttgtgtatccaatacagtactgtagatattccgtaaatataatttttgcaaatataaatttaaaaaaaaatggacaacttttgaaagaaaaatttattcccacgagcaaacacaagatatagagaatgaacgtcacccatagaaggaagaaattttctccatgaaatacttattattagcctataaaaaaattaaatacttattatagatttgtaagctcttctacttgtctcacgtctttctaatttttgcatcatttattatctctggttttcagtacataacacagtagttatatagtacattataatttctcatcccaaagtcttaacatgatttgagaaaaaaaaatcaacttgcatacaatcaattttaatatttagcttttggttttaggtgcttcaagttatcattttcccctattaacattatataatccaggcagcaacttgcttttaaggaccttctcttggtcaaatagaatagaagaaagagcactagttaaaccatggtataattggtatacacgcataatctaagcccttaatcaaactgactattctcatttacattcacatttgacaaagtctaaaaccattcaaaacttaaaggataagaaatcaacaaagtgagggagctctgttgaagtcattcttttagcaccttcccaaacgttgccgcatatataccaaaaagcataaacattaaaaattaagacatcaatgtggtgcaactttagctcacctgtgtcaccttttgataataccaaaaaaaaaaacacattgtcccctccattattattactcaactacaaaagcttttttttttttccctcttcacttatattgatccatcaccccatttagaataaataaacatatcacttctatctctccctcattcacttccattggcctattttagtagtgcaccttttcaaacatgctagcctctgttgaagaagaacttggcacaccaatacaaccaaggaatcaacattctcagcaatcagaagcaccaaattcccttgccaacactagagcaattttcgggcaacctcgacttcaaaggacaaaaccaattatatggtgtgctgcaatactgtgcttcatattcagcctagtgcttatcttctttggaattgcaacactgattatctacctttccatgaaaccgcgaaaccccacgtttgacattcccaatgcaagcctcaatgtggtgtactttgactcaccacagtacctcaatggtgaattcactctccttgcaaatttttccaatcctaacaggagaattggggtgaggtttgagtccttgaacattgagcttttctactcagacagactcgtgtcttcacaaacaatcaagcctttcactcaaaggccaagggaaaccaggttgcaatcagtgaacttgatatcaagcttggtgtttttgccgcaagatgttggtgtaaaacttcaaaggcaagtggagaataacagggtcaattacaatgcaaggggaacatttaaggtgaggttccatattggccttatccatttatcttactctctgtatagcacatgccagatagagatgactagtcctccagctggtattctagtagccagacaatgcataacaaaccgatgatgaagagccaacaaacatgatagaattctttgtggtttcttattattttctagttttctactttattaattaggagatatagctaatggtaaataccagtgtgcaaaacagtgatatgattttttttgtgagaaatgaaaaagagaatattagaggatatatatatatatatatatacacaccatatgattttaattttgatattttattgtttttatttgtagatagagacttgggtggaggggtgttgaagcccttccataccagaatatgttgtgggtggagtttttattttatcttcatctactagtttgttttccagaacgcgcttttgctgaattaactttctgatactgttttcttttatttccttaattgtgtcgtgtcagctgcactaattggaatgccttttgactgttaaaagcagaaaaggacttgtcagaggttgatcattgcgtggtatcaactaagatttcaaaagtatacatacataattttattgtggtgagccttacatgagttacatcccaaaaccatgtcttaatcagaatcttcatatatatgttcgctcaaaggccactaaagcatatgcggaatatccattgctattttctttttatacaaaacggaatatacttgtattgttagtgaccatgaccagttacccaccaagacattactattatttcaggttaacaccacaacggattttgagctatcaaaatagaattttgtagaaaattaattatatgaattctctgaagctaaaccattaatttatagtaggtgcagagtgcagagtgcagacagtaactcggcggtacaatgataattgatgaatgtccatttaagcatatatttttttctttttttttttttaattccttttgttctagcttctgctaagaatgtgcgacggggaaaagtatggccctgtatgggagctattactatacggattacggactaatatgatagactgctttgtatatcatcctgtgttaagtaatttcacattttataaagtataatataatatattactgaacaggaatcacggattggcgttcaactacagagaaacaaacacacttttataagcctaatccttatagttcttggcatatacaacctctcagaagccaacccacttccgcttccaccaacatacttccccagagtagcctcggaattggtaatgttactctgtcacacttaaaaggttggcatgcctatgtttcttctcaaatgccataaccaacctaactatatcgatcccatatcctgtaaccaccagtttatctctatctgctccatttagcgacactgacttcacacctgcgcatccatgcatgcttcccactgttagcttaaccaaccaagtacatgtatacctagatattcttggtcataacataaatattcatggtgtaattaataataagccaagcaagttattttaattaataaaacaaaataaaggtaccctttgtcactgccgcaattttgagggccttccttctgcatccatcacagtccatttgcacctgtataactatgttttggtgtaaggtaaatttaggcctacgaaaccagtatctccagatttgatacttgttgattgcgacctcacgaccatgaacaacaccaatcctgttgtcaagtgagaaattggtggtggctgcttgaagctcagtttggctgaataattgcgcagcagcagcaacatgtcctggctcagcaaaactatggacaggggatgctccaaaatcagatccactagcactactactccttatcgcactgtccactagctcagcaaaactatggacaggggatgctccaacatctgacccactagcactactactccttatcgaattgtccactagctcagcaaaacttattacatcggccatgtcaagtgaaactgtgattgtggtttggcggaggcgtggaaatctactgctctattatgacacatataaacgcgtattttttgagatgagaaggtgcgaggcaaggcaaaagaattggatcagatgagaaacacttgtgtggacacaaccccaaatatcagaaaagccggcttggttgaaccgactttctttttatattgtcgtgttagctgcactaaaataatctcttaatccagaatcttcctagctgttatttactacgttagtttttcttatttttttttttcaaagcaggcatttgaatcctgcaccacccattttgatgatgctttcggggttcagtgaggagggtgcagccgtgcagggacttcgaaaggtacaaaggaaggagggtgaaggagggctttgcaaagctgttgtcacacttttcgaggtttgggaggtgttaggttgggtgtaggagccaatgaggtgttagggttggggaagggaggtggtctcgttaaggctaatttggtctttatcgaattgcttggaaggtgcatttagaattcaaataagggagtgtaggattcatatgtccataacacaatggacataggtcgggcaacaagatccttcaacataaataacaagcaaaggacactgaagcaattaataagttgttagtgtaaacatttggatttgatttcttaagtaaagtgttagtttaaattttgtggataaaaaaaatatagttagaaaaaaaaattctactaaagtgatcaattagatttttttgacaaaaattaatcaattaatttaataataattcccacctatgttaatatatgaaagaaaatgtctctaaagtgagccaaatatttatatatagagagagacacacacaaacggtaatttccttgtatagctagtgactaatgactcaccgagacattactattatccatggttaacaccacagcggattttgagctatcaaatataatttgtagaaaattaattatctgaattctctgaagctaaatcattaatttgtaataggtgcagacagtaactaggttgtacaatgataattgataaatgtccatttaagcaaatattcttttgttttctttgattcttttctttctagttttttttcttccttcaaattccttttgttctacctgctgctaaagaatgttcgacgggtaaaaaaagtacacgcccattattacatcatttacatggactaatataattgactgctttccatcatcctgtgttaagtaattgcacattttataaagtacaatattactgtttctgacaatatataccagcctccctccaacaattatttttgagtggtacgcgccatcaccatttgacattaaaattggctcctataacataataactgatatttgtaaaaatatgtaacccaaaaataagcatgttaatcagaagcaaatgcttcttaggctgtatcatacatatgccagaatgcacccaccccaaatcagtccccaagtccatttagagtatgtttgtttctccattgtcatgctttcttatagacctcaacgtgactgaaccaaaagcatggattgacgtttttaaggtttttaaaaggagaaacaaacacactcatagaagtctaatacttgtagttcttgacatacaaactctcagaagtcaacccacttccgcttccaccaacatactttcccagagtagcatcagaattggccttgcatcttgccagaaatgcctcttgagctttggcaacattctccttctttccaccccatgtcttgagtgtgctttgttgcagtgctcgcccgaatgagaatgagagagtccatggcttcaacacctccaacttgttcattgcattcaggttgagggtggcttcttcttcactttgcccaccagacagaaacacaacccctggcactgcagctgggacagtcctgcggagggcttgaactgtgtactcagcaatcacctcaggtgatacctgcatgcacacaaattaaattatttttctagttaataatatgtaatttttttttcttcctaaaagtggtagaactggaagaccagtagtttcacctaattgcaactacttaactagcctctaagctccaagagagcttcctgaagaaggttgcacaccaagcaagaaagtggcatcaaggaaatttgaatccatacctatgtggaaggtgagagttcgaactgaccagattcttaactactggtgccaactcacattcgcttccaagtaaatcgaacaatgatatttagacacccttaaattactaatgctccaccaacaccaatcatttctcttttcctatcacatcatatcattcatcatacctctactattcctttatctgtgtcaaatagcatataaggtgtccacaaatcttttttgaagtcaacaatattgcaccatacttcattccaattttatttctaagactagtaagtattcaactatagaatgtaaccatacatatggatgtatgattttgaaaatgttaagttacctttgggctatcagagccgggagtaaccatgttgggcttgagaagagttccttcaagaaggacatgctgctcattcagtgccttgtaaacagctgcaagtacagtttcagtaacagcagcacatttggcgatgtcatgagccccatcagtcaaaatctcaggctcaacaatgggtacaaggccattctcctggcaaatgatggcatagcgtgccaagccctgtgcattttgctggatggaaagctcagagggctcagttgggccaattttgaggactgcacgccacttggcgaagcgtgcaccagccttgtagtactgttggcaccgagctccgagagagtcgaagccctgagtggtggtttcaccatttgtgccagccaactcaacaacacccttgtccactttgatacctgggatgacattgttctcttgaagtacctcaacaaaaggcttcccatcagagcttttctggtaaagagtttcctcaaagaggatgacaccagaaaggtattggagggcatctggagcggtgaagagaagctcgcgaagagcttggcggttcgcctcaatgttctcaacgttaatgctcgataggcgcttcccaatggtgccagtgctctcatctgctgccaagatgcccttcccaggtgtggctatgtacttggcattcttgataagctcatctggaattgatgtaagttataacatacatcccatttggaaaccaaagtctaagagttgtaaacatataaagatttagaatgagcttcttagacatgaatgaatcttttataatttgatattatgttccaataactaatgagaatatgatgcatttctcggctactcttttcttgttaatcagtacattaaagtggaatgtttgacaagcttgtacttcattcaatgaagaattgttcttgtttacgtgtgggtgagagatgtgagtaatattaagagaagaggaggagatatgagatactacctgcgtactttccaacaaaggcagacatggttaaagcttattggatatatggcgggaaacagataacagacgacagcacgaaaaaggagtttagccagaccaaagctatatagataaaaatctcaaaggaatataccaagtggtattctacccaacccatgcaaaggaaccacgtgtccagtgattagcctaacgaaggttatcactcttggataaagcaacgagtgatccttcccttgcccaagtggcacctcatccgtttcaataatatatattccactcaactcatgatatataacaaggaaattttgtggaaagctctcacccgtcatcctcttggacttggctttacatattaagatatcaacctaaaggctcttatgaaaattgtttgcagaacaatgtctcagtcacattatttatttttatttttttgtctttttttcagaatcaagttccatcctcaagttacatctttatgcaatttaccctcgctatatattctcaattttgagagtgatagatatttaattaaagaacttacatactcatttatatctatgaagtaaaaatctccggacagtaaaaatgtatcttgataagccagtgtccggcaaagaataagttcaaagaaaaattctggtataataataaaaggtaaatcaaaatttgcattggaatattccgattatgcgtatgtttgtaaaatcaaacaaaagattatgatcaaaattgattttgaacaataactcggagaccagcagaatcttaattcagcaaattttattgcccccttccgcagtaaaagtctcattaatgatgacgaaccaaaaaatattgtgaatttcctcccaagtataactactgtgaagggggtaccaccttctggtcatcattatctgttccaaagtaccggtccccaaactcacccatgccaggtatgacacggaaatcttcattcaaaccaatctcaatctcagatgtcaggatttttattctcggaaatcttttacagaccacatgaacaccttgaggtgcctggcaatatgagagcatatatatatatatatatgcaaatcattaggtacaagaaaagaaagaagcaacagaaaataacaaagaaatggcaagatatatatgatatacagaggaacaacaacaggcacaagtaacttactgatacgagattgagaaatataatgttggactctggtacacccttctttaaaagcaaagaaattgcttgaacagctgaattacctaaagacgaagatattctaaagttaatcaaaatgaaaacaaacaaattaaatatcaatttttttatatacccttattatgctaactgctatgtaacttaagtcgcagttggctactgacggtttgtatattattttaaaccagtaacataaaaaacaccataaaaataaacattatgagaatgacaaacctgtgcctaagatgggatccagcagtaatacatgcctatctgagatgtcattaggcaacttctcatatattagctgctcaataatcaaaggacaagttagtgaatcaccaaaaaaaaaaaaggataagttagtgatcatgaaatgaatcaaaacagtatacccaagcacacgcaaatgacaaacctgttgaccgttgtcaccttctctatgaataagaattttcccaatcttgatacctttgcagcatgctcgtaaagcattttccatactctccccactgaaattagattgcatatcaaatttaaggacaaattctatttataaaaaattgcagtgatcataggttcacatcaaactgagtaattaggaaagaagaactagtttcttagaatatagagaggggggttggataatattttcaaggataacaagtagagtaccatatgcaatctaaacaatttggtaattataaacccaaatcaacaatagatctttctctttattgaattgttcaagaaagtattttagtcaaaactttgtagcaaggataacaatatttaaacaaatgcccaagtgacttctgatctggactaaaacgatacctccggatgatggagacaccacacaacctcttacagaaatccaccccgctgtataccgatcctgcattgaaggacaagtattagcttagctgtaaccataaaaaggttaagacgtgaaacaaactaattctattttgtaaatatttgaaggagaatatcagcaaagatgcagacaggaaagttaatcattttcagtatggcaatcgcagaaattaacatcatgaacagaacatgtctctctactgtaaaataacatgatatccctttggttcccattatatgaagcatttcttagattgggaattcagacagcagaagttattcgtagtccttccaacttggctgaattatgtctaactatgtcttggataacttggaagtttcaagtggtctaagacatagacaattctaaaacaaggctggaaacatgtagttcatgttactcctcatttttgtgacaataatatggcaggattttagaaaccagagatacccaacaggcacatcatccacaacactttctagtgcaatgagaagagaatattgcatccttagttgcacataaaatacaagtaaaggcgaccatcattgaaaaagaacagcttaccagttggagtcgttacttgcttttctgtaaatggaagatgccctaggccatgttctacaacctggtcaagtgggcgaaatttgaccattaatgcttgaagaaaatgccatgccatcactaatattaagagcaacaaatgaaccccatttacataccaaacgaatcagacggtcagaataaaatacaaagtcatgtttcgttgtttgagaatcacgtatcagagtatgcataccccgtatctgcatcgaagcaattattgtgattattcaacttttaatataaaaaaattgaatttggatgttccagatgaacggggaaagatgggatgattgataaagacgataaataacaagaaaggggtacctgaaaagtagactgaatgacgtataaattaggatatattttacacaagtcatgctgaccaagcttcgtgcgaatatgttgtacaatcaagtcaatagccacatgattatctcctccatggggtataatgatatcagcatacttcttggtgggaagaataaagtcatcaaaagccggcttcacaaatttagaatactgcatcaagtatatattataagaaacagttactaatatatggtaaacataaaaaaaggaaatatgttagcttgatttataatcataaccttaaaacagatcattaaagatttaatttcataaaaactgacttcttacatgttttctaatcaatgaaatttcataacagcctctcagcaacatgaactaaaataacatttccaagtcttgaaatgcagtacaagtaagaaacgtgaaagcaaaaaaaccagaagataatcaaaatatgataatggaagtgcaaatggtgtggctgacggtagctacctgatcaagcacagctccaatttcacgagcattgtcagcagtatcacgcttaattcttctagccagacgaacatcggcatctgcactgaacatttcacaatgtaaagtgatagcataacttagtagtgcaacaacgagatataaaatatgcatgcttgtaaatagttagaaggaagacgtaggcaattattaataaaatagaaaccaacaaataaatgtggggaaaaaaagatgaagatagtgtcattagcataacttgaatatgcgttctcctatatcataatgtggattaggaggggggaaatttaagtccatggggctaaaaggaaaatgaatctgacaacagatccatatatagtaagaaatgccgcagaaaaatacaatacagtaagttataaaagttatattggaacttaaataataagggacctgtgtcaacaaatatcttcatattcatcaatgcccgcactcgtggatcatggaaaacaaggataccttccaaaataataacatccgctgggtttacctgcaaaacacattaaaccaacattttttttttttgatcggcaaacattaaaccaacataaaagggaagtatggctgaaattgtattccatataatttcccctctaatggagataaaacgcaagaagaaacatgtactgcatgatttggcaatcattagtacatcaaagtattcatattcaactacgaaaatcattgtcatctcaagcctatgcaataaaaaactattctttagcatgataataaaaactcaaaatagaaaattataatcttggcctgttctgttatgcatttcaagaacgaggagtaaagttactactaaaaagttgaatgttccatatacccgtcttgctggaaaaacatcattcttgtaacccttaaagtcatactttggaatatctactgcttggctgtgcttcaacttgtccatgacacgtagcaattgctcagtatcaaaagcttctgatgacatcaacaacatacattaggaataaagtagctatagcagtctaagaaccattattcacatatataaaaaaatttaaacgttaaaatttccatatcaaaagttgctaccttatcagtttttaggtgtattatactaattatgcttgctaggtactcaagtatcgtaccatacaaaatgaacttttgttcaacctttggaatggctcataatgcatataacacaatttgtaacactctgacatgtaaaatttgcagtggtctcaccaaccatactcatctctaggctaaatgcgagaatattctagctctggaatttcattaacactttcatgtccctaatcagttaattttgaggtaaattctgctttacatctttcaaaggttaatttttccctgacaccacccttgatattcctgaagcattctgagagtaagaaagatggagttgatactaattgaatgtattgaacttgttttgcaagaaatttaagtatctacgtaaaaacataagacctgataaaaacaaaacaatactaaaacgtgaatattattttaggctttctaacccgatcctcgaaaagcattttaggaaaaacagaactccagatataggagaataagtagatttaaaataaaggaaataaaacaagcatccgaataaatttagtgcatgtttcatcctgtataatttcttctctctctctttattttttatttataaaaggacccaagacaaggcctaaacaataaaaacaagactatctaaagaaggattttgatgtagctccggacttttttatccaatcctctcctgagtgatgatgctatataatgtcttaatgtaaagagaaagttactgattaataatgagagactaatgggtacaattgaactgaccaggatggtcaaagttgtaatcttgtactcttgtaagttcctcctcagtcaaattatggtaaaaagaatcctgttgtacaataaataattcatttattacgctcaacgtatcatcatgtacaataagaaacatcaacccaaattctggaacacataccctcaaaaaagataaaagaaggccaaagtacaaagggaacaagtaaaatatgtaataaataaataaaaggttaagggcatctccttcaagcaagtcacacgagttgctattactttataatttttcacttcctcgctgacataatgttttatggctttaataattcaataaaaaatttctccaatctatcaactctaaaaagtaggctccacaattgatcttgctcttttatattttattattcatcttaattttaatttaaaatatttttatgtcatttgttttagtaagaaataaatatataataatttttaattccataaaatgttcacttccaaataactttgcattaatttttaattaattaatttttagaatacatggaaaatactatgtactaataatttaaataaatcaaatcaattataaattaataatatttttaatgtgaaaaaatataaagtaatatattatgaaaacatagtttaatttataaacaatacaaaaatctaagttatttgttaattaaataatttttaaaaaatctaatattttaatatataaaattaattaaagtccattaaaaagtagaaaactctagttgctttatatagtaacggtgctttatttgtaacccatgaaaattgctctccaacatccgaagaataagactcaagttactagacacttctaatgccaaaagagcaattccattgaagatggcttaacagcataaatgttagaaaatacatccaaagaattttttacttttgtcaactaaaaaatggtgtattcaaatgtgttctgttgttgagaaaatcattgacatttggatggaaattttgagggagaaacacatacatgttcatgataaaagaggtgattagaacaacataatacagaatctgacttgaaaaagaaagaggtggagaaattttggtgaatggtagccaatagaatgtcaatgttgcaatgaaaatacaaaacaaagatgataaaatcattccaatagataaggccgaacaaaataccaaggggattcagataatggaggatacaggatgcttataaggcttgaagcattaaccgcaaactattagttgtattcccttaatatctgactcacagactcatatagttataaattctcaatttgatcaccattcaccagtacgtttagaaaaaatcaatggttattacaagcatacagatgctctctctttcatattattttcactttatttttttctcttttctacctcatcatttattacatttactttctcttttatctttcttttttcttctaatctcttcctacgatttcaatctacaccaaaatgagataaatgattggtactttgcaagaattagatacctgattaacaagtacaactcgttggtcatgaagctgctgaacaatcatatcacaaactgatgtcttaccggatgctgctccaccagcaacacctgtgacatacccaaaccaaaaagtaaatagaaaatgaattagaaccgtagataccaaataaaagttggttagatgtgaaattaagacatacaaagttgttacgatcttattttcaaaactcgtgcgtctaaactttgaaacaaagaaaacttcaatgttaagtatgtaagtttgcgggaagctctacttttatattattaggggttagctgtgtgagttaaccacaatttccaactgtaggatgaccaagtaagaggaatgatcagctgaaatgaaattgtgatgcaagaacgtggactagatcctatgtggttcaacttctccgtaagtacttatgaaagaaaaaatgaaataaaattttctcataagataaaattaatttatgcccaagttaaaattagtttttagagaagataaaataaattgtgaagtatgatagtcttcaaaggtaactttgttcttcttcacttaaaaactaatggctcaatggaatcatatgcaaatgcggggaggaaaaagaaagctgctgagatttctctgccataacagaacagcaaaatccacatatgggctctagaacctcagtttatatcatcccaaaaacttaatatatttagtaccctattatacattagatgatacccaacaaacacaagacaaagtaaatgtaccaagtaccaacattgatttatagacaaatcaggaatttatgactacataggcagcttggaatgcaaaaacacacacctatcacgaaaggttgtttatacatgtcagttgctgaagtggttggttgctctgtgccagcctttctttgctctaagccatccatgtgaaatccagaaaaatgaacctcggataaagactccattaagtcaacaactgatttagtacccataggcaatgacctggataaataatacctgaaaatcacagatagagaaatcaataacatacaaatactactcaataaaagaatatgaataacaatagttttaacagcttgcaaatttggctgattggatcaagccaaccatttcactctttggtaatgttactaattttcactaaaagactagccagtagaacaatgctcaagacggattcaccctttaggaggcatcatttgtcatcaagttcacttcaggaattataaggttagctttgtggttaaagggagaattcacagaagttgttaattcgaagtcctttccaaactctcactaatatactaataaaactaacaactaacatttattgattaaaaaaaaaaaaaaaaaaaatcacttcctaaagccatctagatatataccaagggcttttttagtcaataaaaccaaagtgttaatctaaattcctcaagtaatggacaaaacaattaatttccaatctcattctctccacgccatgatctatcaaatcaaattaatcaggacatcatcgacatatacatgacacgcttccatccgatccgatgaacaaaagacatgatatcatcaccatgcggtgcacgtaacaatccatccaaccagagtcagtgagaggttatatttgcgtgcgaagtgcaaagtgcaaagaaacagataaattaaaactggttcagttccaacgtgagcgaattagcgcagccattgcactaaagacagggatagcagtgatgaatgaatgaatgcagtttaaagttaagaaatccagatccagttaaatgaggagaggagacgagaagatcaaataaccaaatgctgaacgatggcaaaacgtacctgatgaactcagaattgtacgaaatagagaaagaggaacggagcgaaagaaagaaagaaaaagggaaaatgtatagtgacagacagatatgatgctatttggtgcactatcagacgctgcctatttacccttttctcttagtttatatatatagtgacgtccaatgaggcaatgagctataaacagaccttgatcttcaggggatcttcaaattaccaccttcttccatcctgaattgaaactactacactgcttcacccaaaagcatgcgctacgttggacaaatcatttaagctattttttttttactaactaaatacttattttttaaataatttctaaatttttttaagtaatttttaatattttttaaaatactatttgaaataatatttttttaaatgctaacttctagcatattttatatatatatatatatatattatctttaacatatttattcaatttttttattatcctttttagaaatgttattttacatttttaaattacttcaataattaatttgattaaacacttataatttaataagttagtttataagtcttcaatttttaactataactaattttccaattttctaactttcaactaacttttcagctaattttgtcaaatataatcaatataaacaagtgctaatgtccaaagtttatttaaaactattgatcgatttcattaatgtgttcataatgcaaatgaaaaaaaatattaaatgtcttattaaatataaggattaattgcattttttatcctgcagggtaattgtgtaattttggtttataggttttagttgcacaaattgagtcacaagtattctccaaagaatataattaaattcgtgaaacaaacactccctaataaattttggtacggtagcacataagttgacgatgataatgtgaagtgacaattaacatattgtcttacacttatattaacatagcttagttatacttctagtctatcaagccttataattgtgagagattaaaaatgcataagtcatattaacatatgtgttagacaatatatcaattatcacgtcaatgttatgcaacacattctattaaaaatatgttatcttttttattaatatgtgaggcctttttaatttataaaactaataaaaaaattgccagtaggtcaaaagcttgagttctagttattttactttggtttaggtacaatacctagaaaatcaaaagtgcaattaagtttttaaacaaatgatcaacaagcaatgggttaagttaagtggtgatggatttatattccttgagcaagtaactaagggagtaagggctcaaattttaatttttgtgcataaagaaaatcaagtcaaaaatggcaacttacctttaaaacctttagctcttcaaagaatattaatcttcttataatctataatttcagttttttaataaaataatttgtttctaaaataagtttgtttgtttgggatcctagcttaaatttagaagaagaaaaaattgaagaaaaaaaaaaagatgtttttacagcttattttctgtttcggctatttttatactattttattacgtaaaagctaatcttttgttgcattcaaaaatatcaattatttttaaatcacttttcaacaaacttactcaaataaaaattgatcatgattatgattgattatacaaataattaactaaacatataattgattattcaaatagtctaatttttaccattatttcaaacacatctaaaatactccttataataccaacaaatcgttgatgcaaatatttttgtattcggtcaccataaataaggtgtcagatttgaactttgtgaataaaaaaatatttttaagagaaaaaatcctattaaagtgatcaatcagatttttcgataaaaattagtcattatcaaaattgatagatatttcacaccaatatcataattaaaaaaaatactcctcacaaccataagtgtatttttttaaaaatgaaataaataaatcatggaataccatatttttatataataatttttaaaatatattttttttaatttcttagaacaatgtgtaggaacacgtattggaaattggtagagattagagaaacggaaaatcagatagtatacgtagcgtatgggtatggaagtggtagagggacagggacaggggagtgtggagtgggtacgtgtggtgtggttaatgacttaatgtgtctatgtttcagtgtggaaatgtcactcactagactgtcatctgtttgggggccccacgcccgcagtatctaatattttgagcatccaccttgacactgaatctcatgtcgggcctaatgccttttcctccttttctacacctttcattatttttaaacaataattattttaaattcatttctgataatatgaatttaattagattagatttattcatatttaataatttacacatttttttaatatgtcatttaatatatgacctccttttttatattattataatttaatttattcttactttaaactaactaaatacattaatattttattcttattaaatatttcttaatctaggttaatatacgagacatcgaccaacgtgtcacattttttaaaaaaattcatccaaatgtcacgcgaacagtagtatttcccatactgtcacgctacctatttgatccaaggcccaacgaaataagtagctgatgtggtgcaattttgtttgtcatgtacttcgctataaaggctagcgaaatacgcggtcaacaacgggtaggacacgtggcagacactacgtatttcgctagagccaaacaaaatatgtggcattggaacacgtgtcacgcatgcatgaattggtggtgatattgattatataaacttcaaacggtcataacttttgatagaaacgtctgattgaggcgtacgatatgttaaaacgctcgaaatttataagagaaggtctagacaaattccctaaagggatttggtcaactatttttttcctccaaaaaacgcctctcagtatgtgaaaattaggatttaggattcaatcatccaaaaaattccttttttctacttttttaattatttaattagttaatttaatgctatttttatttttttaattacttcttttaatttcgagcattttgacatatcgtacatctcgatcggacatttctatcaaaagttagaccatttgaaatttatataattaatatcaccaccaattcatgcatgcgtgacacatgttccaacgttttttttttttttcgttgtcacgtatttctcttggcccccagcgaaatacgcggccaacaaaattgtgccacatcagctacttatttcgctgggccttatagtgaaataggtggcgtgacagtatgaaaaatactattattcgcgtgacatttgggtaaatttttttaaaattgtgacacgctaatcgatgtctcgtatattaatcgtaaatatcaataattttacagaaaaaaaatatactttttatggacttaaatataagaaaggacctctcaaaaaaaatatttaagaaaggaatgtccaatttaatgaactgaattatagcaaaataatatttttcatcgacttaatatcaactaatttaatcttatttaagttattattataagaatattcttaattcaattaaaatgtaaaagttatcttccattaatatgattaaaagtagttaaaaaatgtagttctttttttaaatgaaattaactaacaactttaaatagtataaaattattaattttgtttccatttgaatttagaggaagtgagtgttaaagatgattaatttttttctaattgtgtttgaaaaataatttcttatgcaaaataaaacttacttcagtgatatctaaattttaaaagaaatgaattactttttaactatcagaatatccattgtgcaaacatatatatatatatatatatatatatatatatagtaaatagtgtataaagtatgctctcacgacaacacaaagggactaattaatattgagactaaatgattatagtaaatagtgtattaatgtatgctctcacaatataaagggactaattgagaccaaatggttcaaaggagagaaaggattttaatgaagagagaaagaggagagggattttaattagacattttgtttgggtgagacaatgggagaagaaaggttttaataaaggaaggagatcaatgtagcctttttttttatttggttcataagagagtatgaaattttaaagattaatttactttcgtacagttatgattttaagtttaaaacgttgggatagtttacgtcttaggacactttaaattatttaaattctctcttcatcccttcaaatccttcgttagaagggtgcaaaaattagatacttcatttttttccattctcttatattgttcccaaccagtgaaggagattttacattattgttaattatgaactgcacattaaatttgttaacttttatattaataatcttaaaaatcatatttatgatgatttttaattcattggtaatgtaaaaaatttaagactaactatacatcaaaattaatttttttataataagcattttaagtgtcatttttaattagttaatagaatgaaaaattaaattaatcaaaattaaacttattaattgtataaaaaaaattaataaacatccgtagccagtataattattttatatcatcaaataataaaaaatatttttttatgactcttaaggtaattattaaaaatcaataaattacatatagtaatttgttattgaatataatgtaaaagattgtactattatttgtgaatatattatttattcataaaaaattaaatatgtgtatttaatattctaattgaattttgtatacaatattaagaaaataaaagaattgttaatttgtaatttgtttgttataaaataaatatgacattattcttgatgtacgtcatgtcgtttccgtcttacttctcattttacccgtctccacttgggtcccactaattgtcatccacgtctcgggcctgattcacagtgattcaatcatgccttgaaaatcgaaattgttgaaatcgagagtattctcttgtgtttaacactttaactatactattaaatcaaatgatcaattattgtattagtcaaataattataaggcatgattattttaatggagtactactattatctctggtcttatggacagtgtaagcaacagattgatattatctttcgtcctaattataaaaaaattattattttaaatcctctaaaaataattaattttaaatttatttagagttaactttcatctatatccttaatttattattaatttcgtttactagatattcattcattaaattatgaatactgatattaaatgtgattattacttacaacattcaaatttaaaagaatttttataataaaatttgaatctatgataacattaaatgtgagtttttatttattttattttaatgattcatcatatgtttcttatatatagaattagagataatatcattttatgattttaattaatttcattcaattatttatgtaatattttcttttaatttatgaattttcttttccttttaaaataagtacatgtattttataagtttccctttattaagattttttgtatttaaaaaatattaatattttattttattcatactttatatttattaagtttgataataaaaatatcaataaagtaaaattatggaaaagataagttgtaatattttcatatttatgtaaaaaaaaggtgattccacaataattagtaatatggctaaattaaaatatataagtaaaaaataacttacatttaagagtcaattttgtacaattgagttagactgaaacttcaattgtaagatgatatgtaagtttatcccaatgattatcgttggacttattgagtcattcactagtgagtcattattagaccaattacaaatgttaaatcatgcaaatattacatttgagatgtttagtcttctacatgagaaaagatgcttgagatctcatcaactaataatattgacaaataaaagtatataagtggaagagtaaccttcacctcataagttgattttgtagaattgagttagatcaaatcttgaattataaaaaaatattaataaatgttaaaattggttatgatgcctcttgcgcctccatgcatgagcaacctggctcaacaatgtagtcaagctttgtatcattagccatggcagcttgtcactcttattgtgttgccatagccttatgtctacaaattgaagctctcagtggtactcgttcaacttgggatggatttggcatgtcctccctagagcccacttgacctatgtgtccaatataagatgtacacaacataacaaacctgcaaatcaatataaatttaataaacatataaaaacatacattgatttccaagtacacaagtaaaacttatttatgttgtgtatttgattaggtacatgacataaacttatttttgttgtgcgcctcatttaggtatataacgaaaacaagttccatcaaatctttaagacggaaaaaaggagcttgaaatgctctcttgtgaagtcacaatcaatggagtttaaaacactttgattcaacaaagttagagtgtgatggagagaaagttcaatgggggaagagagggattggaaaagggggcgtgacaccaaaaacaataaaggggtcaagaaggtagaagaaaaactaagaagtgagggaaagggggtgaagggtgttctaactaaggtgtgtcttgaggggtacgaaggaataagggtatatgcatctttttaatgtattgtggtaaatagtaattgagagggtgccaatagttatgtccttaggagaataagcccacaggtcataattgaattaaatagtttcttgtgcttaggtgctaatttgaacattttctctaacaaatattgcaccaggaatatgttattggacctgaaatgtttataagcagggattaactttctacaccattcatttttccaatacacccaacatgcacagtgtaataccaattttacccttctcataacccgtaagttgcataccaacatacaccattcgatttcatacggatcgacaatccgtaagagtcatacggatcgacaatccgtaagagtcatacggattgacaatccatatgactcttacggatcaacaatccgtatgagtcatatggattgccaatccatatgattcatacggatcggcaatccgcaagagtcatatggattgtcaatccgtatggaccttacggattgccaatctgtaaaatcaatatggattgccaatccgtcagcttcctccgtcagtgcttgagttgcagagcttacctccgacggcgaaccggccaacgcaacctccaccaacactagccacgacctccacaaccagctcaacaatgcaagacgcacccaacagccaacaacagcacgcaggagaagaaaaccaccggaaaaagaagaagaatggcgaaaaggtgaggctggtgtatgttaaaaatcaccaagaactttattgtcatttatgaaaaatggtgggtgtatggaaaatttgcctggtatgagaagttaaacccttataagcatcatgtatcaaatgctccaacccaagatggtcattctagaataacaaaaataaataattttatggacccaaaagcaaaacattaaatgtcttcaaggatattcaaaaacaaaataaaaaaaaatatatagtaaaaatatatttttgtctgacagtactttaaacaagaaaactttaaaaaaatatctgccactaaacaaaataaaaacaatacttctttgaaatttttcttgaaaaaagtggtggaatgtggacggaccgacagacctggtgtctcaatggaaaatactttattcgttgtttaaagatttttgtaattagttttcttaatttaatgtattttttaattactttagttaattagcaaaatattttgctctttaataaaaaaatgaattcttattttttttaaaaagaaataaatggcttaagctattgttttatttttatataaataaaaaataaacagaataatatgaattgttttatgtgacttaaaacaatgaactaagattagagggtttgcatccgagatcaccatgaaagagttgttgctactcgaactaattttagaggcccatgtctaacatttgcagaaggagaagcgtgggcactattaaaaagattagagaaattaataaaaaaacggtaaaaaatagataatttaaacatcacaataaaaggacggaactaaataattagagaagttaaacaatgataataaataataaaaacatgaaaataataaattaaatttaaattatacaataatacttgtacaaaaatctaatttatatgtaaatagataaaataaataaaaaagcaagcatctaccctatctaaattggggaatcaacgttcggaaaaatgtttgaattttggaacattttggctctcatgtttctttccacatctaacgcatgtcctggatagaatatagttttatcatatgcctttattcccgtcaacaatgggtcccgtaatctctcttggctatgaatttttatttttaactgtggtaagttacagaaataaactaaatttaactgtggtaagttgacaacaggccacagttgccataatctctcttttcaattatattttttcttcttccatttgtaagattgaaacccaagtgttaattgtgtctatttctttttaaaacaaaaacaaaactcataaaagttaaaagaaagcaaattttggggagcaaaaaagttatgaaaggcacaaacaatattggtacgacgtcattcagggcgaatcgtgccgttcggtgggtcccacagaggaccacagttgccacctaatcagacgccacatcggatacatacgccgttaagacgttgtgatcccccgaggacacgggagtgacggagacaccaacgttcaaaatgcaagttcaagtttaaggttgtttttgttttgttttaagttctctttctttctgtttctctctcaactctcaacacattcaaaccaagcatttaatataagcctcttcgcattttttaacgctcattcatcatcaaatcaaatccacgagaaccctgtttctcctcacgcttctgcctcagatccaatcttcataacccaaagcttcactttcccaggtattttaaatgccaagttctttttaaacccaaaacaatttgaattttatttttcggtggttggattctaatagtatattaagaactgcattgaagcatttctccaattgttggtgttgcaggaaacatgccacaggaaaccttaccaaactctaatttcatatctcctcttaagagaggattgaatttgaaaggttcggcggcttcagcatgtaacaacaatgagactttacacagtttgacggaggataccatcaacgatcatgaattggctcagagaaaagcagaggaagcaggtatcaactttgattacgattatgtcattgcacattagcactgttctcttgttacactcgctatgtgttcgtaattgtcacctaatgcttcatcacaaataaactatgagttgggaacttagattttatcaggtagtactttttaatatttgtattctgaaaacaatatctttgagagcataggaatttaaggttgtcccccaagattgaaccaaaacaggggagtaagaacttagttttagagctcactgaaactagaaagcactgatactatctgtgtttaatttgaagtagttaataatatttcttctaaaaaaaaaaatccaaagacccatttaggaataatgaacaagtgatacttatactaatactccgcaaaaaaagacttaatcttctgttaagattaaataatgaaacatgcttattgcttgaattcaggcacatttcttggaaaagtttcattatttgaacataaatatctttactactctttttttttttttaataatatttttcatatatactcattttaaaaatataccctataattaaaaaaacacccttaaataaaagagaacaacgttttattgtttcacaataatgtttctctttttttttttggcattataataatgtttctttatagtcatagaaaaagtttcttttgttttttccccatttcctctggttttcttagcgaaattgatttgtttcttacattttcttttctattctatctactaaattattacttgcacttgcacattattgctttgtttaagaaaagggaaaagggaaaaaagtattgtataaaaaaacaaagacaaataatgaataattattgtaactagattaaacgaagtgaggctggaaaagagaaaaagaaagggacagaggacaaatgaaaagatcgtggagcacaaaattatatgcaatgcctggggatgtgttgtgttgctctaaaatgggatcactcccccagcacaccagcattcaatggtggcgtgggtctttgacgttgttattcaaattttgtgatttaagcctggtcgtttaaatacatgtcaactattaatttaagaactagtactgcttgaaattcagatttaaaaacccaccaaaatcttgttctattggtgggataacatttttctttcactgccgaatgtaactgactttagtttaggtttatctatttttaatttttcggtaattatttatgtaaaactttaaatcaagaatgtttaatattttcttttaaatttataaccctattttaaaagtaattttatatggtattcaaataaagtcaagttaatacagtagtatttattacactactttacaattaattattcttttcaaaaagtaatatggcctaatttcaaacaggaaacaccatgattttggtacccatttaatgcaacactgctgtaaataacaatcgtgactagactactttaactttaacctttgattaattaaaattcaaactttggcctttgtttaatcagaattcacaaatataaaagcataacagtaaacgacatttcttgagagaatattgtttttttgggtaacatttcttgagtatgaaatgagagtagacatgttaaatttatttatttactcttatgaatcaccattatacctcctcaaagaaatttaacgcaagtttgacatgattttttttataaaaggaatagcgttacttttcaattttaaaattcttttaatgaaattttgattgaaagactatcactagggttgttctaatattgttgtaaaaaaaaagttgttctaaaatgtgaaaattgggaagtgtgtacaagattttaagttataattttgttttttttattataaaataattcacaacatttatctagcacatctgaataaaccatcaattctcttcttaaaaaaaatcttgtgttattgtaaaaaaaataaaaaagtgtgcatgaaacggcggcgtatagacaattggacattacccgccatgtctttgttgttagttgttcaaatgttgtttgtttgtgcttgtgagatcagcttcaaggaggtacgtagcagcagaatggcttcggcaaatggacaatggcgcatcttcatcactctccaaagaaccctccgaagaggaattctgcctcgcactccgcaacggtctcattctctgcaacgtcctcaacagagtcaaccccggcgctgtcgtcaaggttgtcgacaatgcggtggtcgacgacgtcgccgttcagtcttctgagggacccgcccagtccgcaattcagtatttcgagaacatgcgaaactttctcgaagccgtcaacgacatgaagcttttgaccttcgaagcttccgatttggaaaaggtgaccatgaccctcctcccctttcacgtcaagatactaactttgctctattttgttaatggggttgagttatgaagcaccgatacttttatttcgtatcggtttggatacttcacctatggctatgtgtatatgtccaatgcatgaatttcaagaaacattgtctctttcatgaaccaaagatggaaattattcttatttgtagacaataggataggaagtgatttatgattacaatgatttattgttggaaaaaccacctaaattgtggtcacccctagactgaggggtgtgttgaaagtcccacatggcggatagctgtgggcaaaagggagacatgttgaagtctcccattgtctaaagttagtgccgagatacacggtataaatggggagtaatcctcaccttaaaacttggttttgtagaattgggttagactcataactctctttctgacatttataattttattttgtttttagtaatatataagaagtatgttcttaatttggatttgtagaattgcaattatatatttattatgttttatgattttttatacatatctatatgtgtatcttatacgtattgtatcctatatatttctagaataattgtgtcgtattggatacatgtatcatatatgggcatcataggggttgagttttttttgtaggggggttcgtcaagcaaagttgtggactgcattctctgtttgaaagggtattatgaatggaagctatcgggtggggttggggtgtggaggtatggtggaactgtcaggattacttccttccctaaatggtcttcttccaacatactgggcactgaaagagttgttgatgagaccgagtcatcgcagtttcttcatctgtctggagaggtttcagttgaagaaaccaaagctgctaatgctttggcttctgtttttgatcagtttggactcaaacttctcctggcttacctcagagaggctgatggggttgatgatctgcctttgaatgcaatggtaggtaagatcctttcctatgtggtgtgattttgtaatttttaggactggcaaattagattgttgtttgaaaattgttttgagaaattaaatatatgcatgaagattcatttgattcatgtgatcagcaatcttatttgtgattgggtgaaattgtgtaggtaattgatactttgctcaggaaggttgtcaatgatttttctgcattgcttgattctcaaggcactcaggtacttcagaaattaatgcatcttttttgtcttgctatcacgtttgtaatgtaaaatcactttcagtgtttgtaaggttacctaaaatttaacaattgtccgcagcttggacatttcctcaagaaaatattgaaaggcaatactggttgcctctccaagagagaattcatagaagctatcacattatatctaaatcaaagaggtagtttggcatcaaatgaattctctaaactatgcacttgcggtggaaaacgcgatagtaatcagcacaatgtcagttattctgccaagcatgctgaaataagtgatgcccagcaaaaagagctccaggtataaaattgggaaatacaatgtactgctttagatgatttatcatgcggtattagattagcatcattcactgtaatggtgtttttttccctggtctatagaaactgaagtacttatatgacgagataaaattggaggtcaaacaaattcaatccaagtgggaccaagaattgagaaggcttggtaatgatccaatgacttttttttccatgaaaaatattcttcatgtatgtaaaatcttttataatgcaatattctttcataatgctaagtcgagttctatgtactacttagagaatcatataaagagccttgaagaggcctcctcttcctaccacaaagttttggaggagaatcgctctctttacaatcaagtacaagatctcaaaggtacacaagaatccgagatgctttttcaaggatctacttacatgatttatgtattttaatagatttgcttccttacaggagccattagggtctactgcagagtgaggccattcttaccaggacaatcaaatggacaatctactgtagattatataggagacaatggaaacataatgattatgaatccccataagcaaggaaaagatgctagaagggtattttcattcaataaggtgtttgcaacaagtgccacccaaggtattttaattttttgacatattattgcaaaatgtatagggccagcaaatactttgttctatgtgattattcctaaatgactctctgtaaaatgtagtaaagatttgaaaataataatggacattttttgacatgttgttttagataatagagatttggttatgtaatgaagaatgaacaaaaacgagtatttgtatactggattgttaaatgataataatcatgatatcttatgtaatgtatttgttacaaataaaataatcttttttgaaatttatatcttctctgtcaaaacttatatgatgatttttctttgtcatgtgcagagcaaatatatgctgacactcaaccattggttaggtccgccttagatggctataatgtatgcatctttgcatatggacagactgggtcaggaaagacctacacaatggtaacattacatacataaaaattctagcacatagaagcaatctatcacaattttatgcatttacttaaattgaagtgttgtcctcattctaaattctctgtttttattgcatgcctcataagaaagatcaaaatttatgtgttttgcactgaaattggtgactttcttttcatgtactagtagaaaaatgtagatttttgtccactgtttgtggtgcatgttatggatacttgaaatcaagaatattatgatttgttatggtacgcaattcttttaatagtatcttatcttggtttggagatgtttcttcttaaaaaggagacaattaaaattttaaaaagacctgcatgttattaaatatgttttcatcagcacaaagaaaactgattgtattatttatggacttgatcaaaccttaaccacattgaaagtgtgatatcacaaaatcattttaatattgtcttatcatttttcttatgcatgtgcgttttactgcttggatagagtggccctgatctgatgactgaagagacatggggtgtaaactatagggctttgcgtgacttatttcatatttcaaaggaaagagcagatgccataaaatatgaagttggcgtccagatgattgaaatatacaatgaacaagtgagagatttattagtcagcgatggctctaacagaagatatccttcaagcccatacattctgtatttctattaaattgtaatcatttttcacttctgtatatcaaaactttttgcatactcccccccaaaaaaacaatatcatatatttttttggcttgttcatttccttaacaagacatacattagatatacgaaacaactctcaattgaatggtcttaatgtgcctgatgcatctttagtcccagttaattgtactcaagatgttcttgatttaatgaaaattggtcagaagaatcgtgctgttggtgctacagctctaaatgagcgaagcagccgttctcataggtaaaatttcttcttcataaatattgatggctactttaaccatataatatatttttcttaaataaatttctttaccatccaattgcagtgtgttgacagttcatgtcagagggagggacttagtgtctaactccactcttaagggttgtctccatcttgtggatttggctggaagtgagagagtggacaaatctgaggctgttggcgagagactaaaggaggcccagcatataaataaatctctttctgcacttggggatgttatctctgctttggcacataagagtccacatattccttatagaaatagcaagctcacacaagttctacaagattcattaggtaacaagcagacttaaattgatttttttctctctgtacacattcctcattataattggctagaacaaacttaaaagttgggattgttttctttttcagcttcaaccaccatctttttctactacagatttttgccctctgttgttttaattgttttttagttgggaaggggttgagatgggttgattaatgaattgcaatttaaatattgatattaatgtatttggatcattccatagtaattttatatttttaatttctgtataaaacaacttaacctgtgttttttccctctatatcaataggtggccatgcaaaaactttgatgtttgttcatataaatcctgaagtcaatgctcttggagaaacaattagcacacttaagtttgcagagagggttgcaaccattgaacttggtgctgctcaatctaataaagaaactggagaaattcgggagctaaaggaagaggtttggtttttggtcataactatagcaattttaaagttaactttagccaatattataacagtttgagcattttatagatatcaaatatcaaatcagcattggagaggaaggaaactgaactacaacaatggaaagctgggaatacacgaaataccatagaatctcagaaagcaccaagagctgtttcacctttccgtttgcccaaaaatggtaccagtgacaacatgaaacctgaaaattgtcaaagacccatggatgatagaagctctgaggttattgcatgcttatataaactttaatgataaatttggttaaattatattaggaaattgtatcacaatgaagtgtaatttgtactctctaaatctgaaattatatttacaggctaaaacttgttcttcgggtaagcaaagaaggtcaagatttccctcaacatttatagagaaggactccatgccaaaaatgtctcttctagctgaagaaaaattagtgagctcagggaaaggtagatcaccatcacctccagtcaggaggagatcaatatcgactgatagagggtctgtcattaaaagcaaggtcaaaagtgacacatcagacaaccaaccaatcttaaagcatccatttccaactagagtactagtaaataaatcgcttgtcacaatgccaatggcctcatctacagagaataattcaagggtgaatctgcattcacaggagccagtgaagcaggataacactaatgaaactctcttcaacctccagatggtaaactccaggaaagttcatcaagaacacgaagaggaacaaatcaagcaagctcctggttcagtaagacaaggtggtactaggaacaacaaggctgaaagtaaggccaaggttaagcattttcagcaattgccctttaggattcaaaaggctgatatgatacctggttttgacatggaaattggccgtgaaatgaccatggaggcacttcggaaaaacgattattttgagccagaaaatgatatacgcctcatggagtctgcagtcaatggtgttgtaaatattaaaaagatacatcagaacatctctaggaattctcagaacattggatcaaggtatggcttaaagaatcattaaaaaattatgctatgctcgttgatttgtttcttctcattgaaaatgacattattcaaagcttgattgataaatgagtattattgtcacatgcagaggaataatgcaagcagctgagcctttattgtccagcaaagttgaaaacaaaattttactacatgctacaggtcgcaatcttaaggaaggcaccaatactacattgcctgaatttagaaggagccgatctacgccacgtgggaagttttttgttttctcttgaggatttcaggttaaaatttgataattttttacattatttatttttgtacagtgacaactattgatgtgcatgttggagtgccggctcacataattttgttgactgaggtctcgaggtcagtttgtgcgaccttttcctctgttttcgtgttatgttgctcgtttgtaatttaaatttttggatgtcattatacttctgaaatcttgaggtgttgtgctacattgataagaggtatatttactgcattttatgaattcagcttcccattacaaattcaacaaaagtaatggaagaaggtaaaaataatttattgaaaagcttgttattacaattgtacaaggttgaatatttttttaattataaaatattgtatttttttaatatattttacaaattagtcctgtatttttttttttttttagaaagcttctactgttagcattccatttcatatcaacgttcagactttagcgtatacatgtttcacattcagtcaaattattatactcccgtaactcgcccatggaattattgaattataatctctataggacgctacatgtgtacttaatggttataaaaatgaagaactaacaaccaatagttatgaaaattgacatcgaaatattaggtcagtgagtcagatgtttagttggagggttatttattaatccggtatatatattaatatttttaaaaatatatataatgtatctaatataatgtgattaattcatatttttattctctaaaattaaatttattgtcacgaactaattataaaatattatatagttatttattactataaattattattattttattggatattattattaaattattaagaaaacttttattttttaagactaaatacaaaagttatcaaataatcataaataagtttgttaaatatgtataaaacatataaatattaaattatattatgatcaatatgataataattagttattatatattgttattagataaaaatatatattataggattatattatatgttattcaatgattaactattaacaatttaacatataggaattgagggaaaaaaaaacttgataggatcaaattaggccaacttagtttgggtcaccatatttgaccaaatttgattaggtcaatctgggccaaactaaattgaatatatttccggtcttttattttaattggaatgctcagggcactaatattgattgaactagtcaactaatttagaccgatttttataactatgctaacaacttgacctttttgtataaaattctaaaatgagagactgtataaaaagaattgaaatattttgaggagcctttactctctctctcacacaacctgttcaatgccaaaacacaggaaatggtcaaaggataaccaggaattgaggcaacaagatgacgatttccaatataataattgatgtttattgctttagaaataaatttaagttcaatctcatcagaatattaaattagtttttataacttttggcatataaatatataatatattataaatatagggttttctctcatggatataccaatttttcagttagtatagcaaggtgcataaaaaatttagggcagaaaagccaactttatcttttattctaattctaataaactcattatagggataatatagtaatttgacataatatattaggtgcttctctctcctaaacaaattctctcaccatgttttcggatctgcactgcaccctcctcgacatatcatcctcaatcgcggcttccgttttgctaatttgcacaacacggttttgctaatatcctctgcataaatatggaactatctcagttgttattctaaattttcggtgcaccttactaatgcacaccaactgaaaatgtggtgtgtgcatattagcaaaccccatatattaaatttaagtccaacctcgtcataatattcaatttaatgtatttacaaaataataataacaatggaaggattttctaaaagcatgctatattagtacctgataacatctcgaccagcacattcctttgatgccttttttccaaatatgacgcttactaaaattaattaggttgaaaataatgcagaaaacggctctagtagggttaaagttataagtgcaacttatttccattttcatctttcaatttgagagagacattaatctattaatagataaaagcaataaaaaggatcatatgttctcgtgacatctcattgacaaccacaacctagattttgttcctcaaagcgtgtcttaattttcacataaattctcaacattgagattcattagtcattcaacctttgattaagaacccctttgaagctgttcgtgttttgaatcaacaaggcgtgaaattaagatgatggttcattgttctattgttagaagcatctttgatgggtttaccaattataattctctttgaccattggaggccaaagaggatcaattttcgatcctacaagaagataagaaaatcatatacatttgcaggctcaatccagacttgtccaagttatagaatctgtgatgttagccattccaaaaccacattccaggaagaaaacaacatgcaaggataataaagccacgaaaatagatgcccctcagagttttgtcacctttgtttatcaaaccaaagtagcagaattgttacgaagtataacagtttcatggtgcaaggaccccacgaatcatttcctttccatgagcatcgacaacactttggaagagaacaagtacacctgcaagattgatttggaatccgggcaatcttggggtaaaaagggtcttagatcatttgaaatagcaggtgcaagagtagacattttttgggattttcggcatgcagaattctccgccacaagtccacagccttgctcgggttattacgttgccttggtttacaagaaagaggtgcttctgttgttgggagatttggagaaggatgcttatgaaagaaccaaatcaaaaccatccctagatgaggctaccttgttgtgcaagagagacaatgtgtatgggaagaaaatgttttgtaccagagccattctggaagatggtaagacagaacatgatgttgtgattgagacttccctttctgggcctgatgatccagaaatgtggattaacatagatgggatgttggccagtagaataatgaacttgcattggagattcagagggaatgaaatagtgatggtgaataatttgcctgtgcaaatcttttgggatgttcatgattggcttttcaccaatgaccttggtttaggccctgctttctttgttttcaagccagtctttttggaaactactagcgattctaatagcatagaatgcctagaaagaggtgggggtagcaacggaagtgaattactagaggagaattcatccacccaaggtttttgccattatctttatgcttggagaattgcttgagattcattgtgtgttctccaaaaagtcttgatcttttttggtagtaaagcaaaaaggtgttgcttttcatacattttctttaatagcattgacatcgagttattgaaaacagtgtctcttgcccctttcttatttttccttccttgagctatttgatatatatgaccaggaaaaatagtaactaaacaactagcttaaatttttaaggtatgacctataataagttaaattataaaatggatcttctgaattagggtgtacttggaaatctatttacacctttctaaacttaagttttcccacatctcggtacacaaatgtagaaggaaagggaaggatggattgactgttaaattcaactaaatatattttcaaacacgtacgtagtttagatttataaactcaaaattcactatttttaccaaattataacacaaccaaccacttaacaacatttaaaaatgtcaataccatctaattgtgtcttaagatgattttgtaaaattctttaaaaaaatacaaagaatgaaacatctctctctacacacatacataaatggtttatatatatatatatataatgtgtccatgggcacatgataaagaaccttaaatgccaatgtttataattattttaaaaagttttagcacaataactcctgtcagcttgtttcgaatgtataattatttctttgtatagctacttctttttggatgtcaaaccaaattactacttaataagaattaacattccttgaaaaagaggtgatccagttgtaccaactatattttgttacaattgtactttagataacaacttgtgttttaatacaataaacttttccttttaataaaaaatatatttaatttattttttatcatgtgtccacgtaaaaacactcattaatttttctttttctttaatttaatatggtcctacaaaaagttagaaccaataatatcatgcatactatccaattccttatcactcgttaaaaattgattctaaaatatgagtggagattggttcaagtgtgaagttgtgaatatgtgattatgccagctattgtatcctgcattttcaattacatttcgaaaagtttatttgggaataaaaatttgcaggtgcaggaaacaaatgttatgccttgctgactgtcagagagtgacaggccaagcccagacagcccgttttaactgggtcatggggaaatcagcccgattcaaattagcccagcccacgagggctaatccgggccgacccaaatgtcaggccccataccggaaaacaaaatttggacaaaataaaaaagaggagaggagaaacgaaccaaaaatggggaaccccttcgtttggaaggcacaaattatggttgcatgaacatggcaggtttcgcggcaaacatcggcttcaaaatcccgtcccactttccctgtcgcgttttttcaattcatcggtaacttctctctctcatttttagctctaaaccttctttggttactgaaacaaaatggcagaaaagcttgattcttgtgagagtaaatgagtaatggagttctagtttagctacccaattggaagcattctactgggttgaaggaagttcttcaatttctttctgtctctccacccacttacatataaatataagcttcagctttctatagattctgaaacattttgaccattgttctaattatttattttttaatttggtattaaaaaataggagtatttggaagtttcagattagcttgaagagaagagactatagttcttctgttcctgttaggtgcatttccagcacatcctgcagggtgaaaatacttgaaactgcactgccagtgaaaagcctgggatattgtagctgtcctgatgttaatgtgctcaagataaatggtggaaaagatgtgcatgcaacaattgcacattgtgaaatttctcaagacccgaatgaaatttgccctgacttattatttgatgacagtgaacaaggtaaacttctattttctatttaatatgatatggttttggttcatcatttggtagttagttgtgcttcgctatgcaggatgcaggggaactacgtcactactacctatagctaaatacaatagatttatttgtgattttaagcattctaattcaatttgatgcctgacatgggattgttgactcggatttaagtctggtgattcaatgttcttatattgtggtactggataaactcagcttgccataaaagtaataagagattgttcacacttttgaggatacattgtgatttgtgattgatggtctttgtaattgataaattgaataaaaataagcttcttacaaaaaaaaatgacgcttgttaagaaaataatgggaaagaaaggagaagcttatggttaactaaagttaattttctccaggttctaataggatcgatctccttctactattaagattggggatggataataggttcatgcttctagattcagtgatatacattgtgtgtttgttttcaccgattaaaaaatttacattcattatcttcttttaacctgtttttaactctttaaaacttgtggcttctttctatctttgttgtaatgggatattctgctgcggaaccaaacattatgattagaaatgaaacagcacttacaacttgtatatctaagaagtgaagttgttctgagcgttgtaatttgtgattgtaggttctttggatcaaatggaagaggttggagagttgacaatccatgagggaggagactcttgtgaccaggaattgatacaaattgacaaatttacaagggatgtcgaggaagctgctattaaattacttgcatctaggttaattgttgtctccccttccctcctcccagaaatagaatttattcagtgctagactagttataaactgtattgtcaatccaattgaagagtttctgaaccaaatatgggcgagcataatgcttgttcattttttaagtgcaacaaaaatcaatttttgccatgctattatgagtttgcagttaattgttgctgttttccctgttgaggaaacttcctttttaagttttactcagtgtgtcaagtatttaccttctttcaacacttccattaagaaattgaagaaaatgtcaagtacttcatctaagttgagtttggggagggtacatgcatgcatccttatctccttaagggaaggctgtttccaagatttgaacttgtgacctttaagtcacaaggcaaaaaccttactatagtgccaactgccaaggctcaacatgaaagctaaaagacaaatttaaaacatagtatgtgttactttggcattgtagtcactatctacttacaaatatcccatgtattttttttagaaatttcaacttgattgaagttgtttgtatatttttatattgaagaatgaggttatgccgaacgaagtgttatcttatttggcatgcctttagaaacatcttagcaaattgtcattaacaatgaatttctttgagttgagtttgcttataagttgttaactaagagaagaaattttgtaataattagtaaactaatatcttttcccttttggaaagaggagtgtgcatgtttaaatgtaaaaatgcagtcttttcttttaagcatgcttgtctctctgttccacagggcactcacagcacttgagttgagaaagaaattgcttggaaagagattctctgctgatgcagtggaggcagtgataaacaagttccagagaaggtatgtagttaactagataaaaactgtggagagctgttgtttattagccaattttaattgcttccttacttgaagctttacttgcttccagacaactacttcctaaatttggtttcctttaagttttttatccagttacaacaaattgagagcaatatatgttatgttatgtgatttctggccttaaaaatgagatgtctgcaattataaattgctatcacaaaggtgactttgaatgcagctctagccaactattaattcagtcatggggtctccatgagaaaaatggctagataactggatattgaggaagaatgaatgtcttgagaatttgagtggcccatctaatataatttgacatatggtcatttaccaatttaagtcttatgtagtatatatgcatagagttgtttagttttttatacagcacgtagatcaacacttattttttcattttaatttattttgtgtgtcagaaactgatgaactatttttccacctttttttcattgaagagcaaatggatataacatatttggattacagaaaacagggaaaaggaatcaagaaatttaaagtgtgtttggtatggcttgttttgcagaaatatcaaataatcattttttgggcttcctgaaagtgcttttgaaaccgaaaaagtttcacctattctatgtgtttggactaacttattttgtattcaaaacaacttataataaaaaggaaattatgtaagtttgctgatattgtagaatgaaaaggaaatgatctctgcttttaccttgacattataattttaccaggtcacttgtggtgaagggtgattacttgtcaacaatcaactcactgaaaattgttttttagtatcttagaataaagaagagtgaagatgaacattaagtgcggttgtaatgaagatatttattaacacaaatcatggagtttgttttgggaatcgaattttgttttttctttttccattttaggatgtagttgtttgactgtgagtaaagcttcaaataaaggatgcatttgaaaatggctgataaacaacagatctactgtttttatatgaagttaacatgttttctttttccatttaacttttcttgctttaggaaggatagagactctgaattttttaaaaagagagtatatcctatgattaattctatattaattcaaacactattattttatatatgcagataaagtaattctgttctattcagaataaactgtgtggtacatgcatctcaatttttttttaaaagtttgcatatacccatttatatcatgttaatttgatattgtgcagtctttttcaaaatatgcttttttaagttcatttataaactgagtttgcagacatttttatactttatgtttacttatggtgattggtttaaccttttttgtatcagagggttcatcaatgataggttgtacgctgaaacattttctcaatctagatggacttcatcaagttgggggccaaggcggatcaaacaagttaatcttctttgcattttttgtttgtcctattactttttgctttcttacatgttggctgttccattctgcttttttatcttcttgatcaatacttcttccccgtgttttgttattaatcccattgcagtgcagaagaggaaataattgtgttagcattatgcttatattgtgcttgctaaaattcatcatcattttaactctagaatatagaattaggaggaaaagatgacgtgcattgtgacagcatcttgctaattcagcagagcagtatgcattcactttttttccctttccacaattactcttttgggaacacaaatgtgaaaatctgaaaatatatacttgcatacgaggacaatgttaaaataataatatatcatttactaagtaattatctgtatctgaaaatttagcttgtgcatgtaatctatattttgatttttccctacatctaaaagcttttgaagtttaattatgtcttttgcctgcttgacttgtgtcataatttggcttatttttcatagcgaattgttcaacaaatgcaaagcttcgacccaattcttttctcttgtaatttatctgatcgaataatttcttctattacttggctacttgttgagggctctatttatttcattttaaaactatctgattatttttttcccaaatatgcaaaaattgcctagattgaattgaacctaatcccttcccctcctccagaaaaggtaaaaccgattgattgaaggcttgaatcttctctactcatcattttcctcgagtttagatgccccaaacacactatggatgcacaaaagcagtgtttgcttaaaggttctttactgttgttgtgggccatgcaaggccaaggcacagacctttcaccccacatgccttcagtgcccaatagccatatatacctgctatttcatccaagggagatacttttgtgtgatggattgcaatttttgtggcaggcactgttcaataagggagttagtcaagctgatgctgagaaggcagttgaagtggtctttaaggacaatgattgtgccgaagatcacaagtcagttattggcttgtcaaaatattccatggatcatctttatactcaggcctcaaagcagtggttcagaggtcagaatgtactcaaggagacaaggaaatcacgaattgttcggtggcttcagtaccgtggctttgactggaatgtcattaacttcatactaaagaaattagacaggcaggaccagaattctccatagtgcacaattgggacatccaacattcatatccatctggaaattcattggtgggctccatacatgtttcttgaaaatgtatagtgtgtaatatggtagggttgaagcctcctttggctcttaatgctgttgcaagaaaactaatagttcattgcttcaatttgctcaaggccatgtggcatttgaacacacaagactacacttgtctgggtacattgatgctacctttttttcttgttgaggctgagacagcagcaagcaccactaaggaggtgctacttgttgtgagtccactgtgtcaattcttgtagatatcgtgtgatatgatatgatctagaaacaattgatgcgtctgcttatcttaaatgtgtgcttacgctagaaaaattatcaacatgcctatccaataacagtcattcatcaactagcattcagaattctagagcagaatgagtgccattaatgatatgatataatggcatgtgttgaattatttgattatttcataaagcgtaggagacttaaagggctagttggatgcagacgtgcagttaccagaactcttcaatagcaccacagaattttatgtaattttttcgttttaaatatatcattttattttcacattgtttgtttggtttagctttttttgaaagagtgcttattaaaaataagcaattattccctctaaaaaataggtctctcaagtgtgcactaagtttttccttaaataaaatttgtgaaaaatgcgattattcttttttaaaatctggaacacatttatgaggaattgcatagaaaactatcgactttaagttttgcttataaaaaaatatttttaatacattatttattattaggttaaatttaatgtggactttactaattaatagtaaattcaagttatttattgagactcttataataagaaaaacagtattaaaaagagatattaattaatatttttgtagaaaattttcaactaaatatgttaattaaatgaatttaactagaacgtatgacaatgtaaatattttttatactgttaattaattatataattaaaaattagtaattttgttataattaccttattagtcacacataaaatattatctaatttattaataacataattttgttaacaataataatgtattaaaaataaaatataaccatattagtgttgcttgaaaaatattcatcttttttttaaaaagaaaacatattttacagaaaagtaaagaaaaaaagaataaactaaagggtagaatttagtttcctctagtcaaattagtacaaatacatggatgattacaaattagtacaaaataaatggatggattaaaaaaaatgttatatccttttacaatatttttatcaaaatttctaaaacttataaaaaatagttttaaatgaaaaagtaaatgcatttaatactttgaaaatataaaaaaaatatctaataaatgaaaatattattataaaaggatttaaatttgttcataatacaattttcagtgtttacagtcaaaaggaaaagcaggaaaatcatattctgatgagaagaaatgttactttatgacaaatccatgctctaattttcttttctgttcctcctattgttgaagacattcattagtataaaataattgaaatcttcttgcaacttcattttaatttactttattttttgtggatattttaatgtacttaaatcgttattctcgtactcattcttttcacatataatgcaatgccacaaactctgctcctcaattatttccagtcctcttcgtactcttccaagaaatgccagaaagttgttcacgaaagaatcttataagatataactgaataagctttttggtcagttcagagaattttgtgaaccttgcaaatgataaaaaaaattcccttgttcgtatttgcaatctgcatatgctgctggactaactggtctatctgttttacatgttacctttcacatttccagaataataatggtcctgcatgtacatgtgcgtgtgattaagatacacagactttcattcattccaaacttaatatgtgcttctgaaggagtttccaattgttgcaaatgcaaagtctctttcagagagcacatgggacatgtgaggtattgaacgtgggaccatgtggaattgaaaggctgacttgagtatgcgtgcgtgcgtgtgaataagtgaaagagaaagagagagagagagagagagagagagagagagagatgcagcctaagaatcttattttctgtgtaatatccaaaaaaattccaatcattgtaattaatatcacttgttgacagattatttggataaacttaccttagaaaaaaataagaaggtgaaatgaattaaacttgtccaataagttaaaatcaacttatgtgctccagtttttagaaaagttagatgagagaagttcaattttttttttcctcttttaagtacttatgtagaagtttattaaaaatggacttttaagtctactgtgtttattagaaatgccccagttggcagtaatatctgagaagtttcagcacttgtagaccaggaaattattatcattttccatgttagttaattcaccacaaagactaaaatcagaacatcaaaatttgaattcaggtaaaagcacaaaggttacaaagatatcaataatgccaaggtgacttttacatcggattgaggaaccacctagcctgaaacttaattaatttgttgggtgaaaggctctagtctctagattctagaatttttttttattattattatttaaattgaatacatggattcttgaaatatgcattacatatcttggattaaatttgaacatctctagtaattcttctggccagctctaactgacattccatttgtatgcacatgttatgaatcatacgttctctatgagttgcatgcttgctcaacagattgagtcctctgagaaattaaaggaacaattagaagttccatgtgaaacacctttcataggaggtgctggagaagtatgcactgttaaaactccctttaatacatcaggacctgtggttgaggcctcaaaaggtcgaatttccttgagcattgcaacagtgtccttcattgttggacggtcctcggctcggttgctgacacatagaaatgacacggctagagtttgtagcatttcatgcacagtagaaacagttctccctctcagctttgggtcaagaatgtcataagggtctcctttgctagctaagtggttcctaacccactgaaccaagtgcgcacccccaagaagtgttgggtctagggggtgtcttcctgtcaggacctcaagtaggaccacaccaaaactgtacacatcactcttctcagtgatccgttgcatagatgcaatttctgtacatataccaaaacaacaaaaaattagtactatttcaaggggttatgcaagtaccgaaaaataactaattcaaacatagcgtgaaaaaagtacctggagccatgtatccataggagccagcaaggtagggtctttgaactggcttggaattagtataatcaccattttcacttgcaattcttgctaggccaaagtcagcaaggtaaggctgatagccaggacctaacaaaacattcatggctttgacatctccatgcaatatggaaggcacacaatcatggtgcaaatatgcaagtgcatgagccactcccaacataacatcatatctggtctcccattctggttttccctttcctgaaccatgaattaatgagctcaggcttccattagggagatactcataaaacagaagcttcatgttcttgctggacccccaacccagaagcttgatgatgttcttgtgcctaattgaacctagtgcttgaatttcagaagtaaatgctcctgactctgctgatgaccacatctttttaactgctagtatttggccatttggaactgtgaccttgtagacaactccagcgcttccggtgccaatcacattggatgatgtcaagttccggacaatgtcatcaatagagaactcaaacttctgatacaaagttatcagccaattgttgtttccattgagtgctttgttagcaacatgagcacggatcaagacatggatcgtgagaagtactagtactgcactggtgcataagagagtggacattataatctccatagccaatctggcatgacccttggcctcctttctgtcagctggagttgcaacaccaccaacaatgtagagaccatcatttcctgtgagatcgttgagagggagtttccggaagaatggtgtgttaggcaattctccagagaaatcattgaaggaaacattcagtgaaacaaggttgtgaaggtcaaagagagcatccaagttccctgagagcttgttgtgggagaggtcaagcactccaagttttctaagacttgagaactgagttgggatttcaccagaaaactggttacaactaaggttgagaaagatttctagtgaaggaatttgagcaacttccttgggaatttctccagagaaactattgcttcccaagtccagaagttgtaacttggagcaatataggatctctgctgggatgcttccactgagttgattctttcccaagttgagtttggttaattcagttaatgaaccaatggaatgactcagttcacctgttagcctgttgtctgagaggtcagttaactgcaggtttttgggcagattgtctggaattgagccactgagactatttgaatggaggtccagaaactcaaggttttgacatctggataatgttgaaggaatctcccctacaagatgattgctgctcacatccaaaaagttcaatttcttcaagttggtgatctcagatggaatggtacctgccaatctattgtgatttagcctcagcctgtagaggcttgtgcagttacctatctcaggtggtataaagcctgacaaatcattggaaagaagcagcagtttagtgaggttccttagcccaaaaagttgtttgggtattggaccagttaaattgttgtaagagaggtcaagtgcctgaagatcttggcactgggaaagactatctgggatttttcctgtgagcttgttctgccatgcaaagaagagagtcaagcttctcaagttgccaataagaggaggaacctccccagaaatagcattgttgtcaacttccagttgattcagggaagtgcaatttgtgatttcaggaggtataatgcctgaaagcttattaacactcagttgaagcccttgcagatttgatagcttaccaaaactggttggtatgctacctgtgagaagattttctgacaaatctatgacttcaagccgtgtgcagcttccaagctcttttgggattgtacctactatattgttttgccacaagagaagattctgaagcttgctgagctctccaatttgacttgggattgaaccagagattgagttctgatacaagtacaagttctgcaactcactgcacttccctatctcttctgggatagggcctgacagcagagttgtgtaaatggctatggtctgaatttttttcagcatccctattgaagaaggaagactcccagaaatgctggtttctgcaagtcctaacaccaacaagttggtgcagtttccaatgtcccatggcacctcacccttaaggtttgtgttccctcctactctcaacacttggagctcagttaaggagccaatactctttggaatttcaccactcagtttgttgtcatagagtgtcaagttcacaagacttgataaatttcctatgttggatgggatgttgccttcaagaaagttggcatgcagagctaaagtctgcagtttgctcagcctgcaaatttcctctgggatttcacctaagagagaattgccactgagatcaatgacaatgagctccttatagtctccaatttcctttggaaccatgcctgtgatgttggttgttgagaggacaagagtcttcaaggacctgagaggttgaaaatttgaaggtagtgaaccttgcaagttcactgacttcaggtttatctcaaccacctctccttgtaagttgcagtgcaccccaaaccaattgcatggacttgggttggaaggattccaagatgctagtgcatctgaagtactgtttaaactgttcttccatgctaatagagcttggccttgctcattaagggagtaacagcatggaaacaaaagagagtttaataagagaagcaaggtgagggagaagattttgggaggaagtgacagatttcttaagatgacaggcattgctgtgaaagaagagaagtggtgatctgttttgggattgtagagggggaaattctatgaattttttttatagaggaagagaagaagctctggtcagaagagctagcttccttgttcttttattgtgtaataagctcctgttcaatgacaaggacatctccatacccatgatgatgtttgttggtttttattaagctaaacttctctttttatttatttatttcaagatgaacctagggtatctctagacgagagtcaaagactaatctctcaatatattgaaatctatctaagagtctgaccttttccaatatatgttatttcttacacaaactctggggatccaacttatgaccatatatttaaggagcatagttatccgtcaatcatactacactatcttggtaaactcctcttttttattggtttgttgtggttaacgtgtcaagtagtgagttgaaatttttagaaatttgcgatctaaatgtaattcaatttgttagttcctgttagatagtgtttcattaatagtgaactgtgagacatgaaactggttgagggtgaaaataatgtaaagaagattttgcatttttgttccccacgtggacacatattttatattgtttcctgctttaatttggtaataataattacttttcatcttcatgtatttaatcagctgttgagattaattagcagcaagcaacggaaaatgactttagcacttttttgaaattggttattaatgtaattatcttaccttgctctagatagtgatggatgattaatcaaacagaatagacagtttgatggttgagtgtaatagctctctgttcggttaatcaaggagataatttcttcctttaattagctaggcccattttgtggtccatcgcttttgtgtggctgtagtttttgatgagccactgatgtggtggttgctgcatgctaccctttgaatttctgaactttaagcaactaacttgcatatttggatcaaattaccaagagtgcaacgaaaggatttggttccattgtcaaaatctaaattgggtatccatgattggtgtcaagtttactcaaattactgagatattcgtggtgattaattttataggagcaaaatggacataatttagttcacaaatagtaataagacacatttcggtttgtttatatatacttaaatgaaggagtgcgtgaggaatctgatggagaagtgaagtgcacatggaagcaagggaatacatgaagaacgatattataatatgtgcatgatctgttcataagtatttgttggtctttgctttaaagaaataaaaagaaaaccatgaaaggtatgttgaccaagagtggaaggtacaaatttacagtagattgaactattgaattggaattattcgcaaatcaaagctagataactagcaaaaaaaatgtccatttaaatacataaatctaccttcttaatttgcaccaaagtggtcatcacgtgtcacggtttaaaactagaaaatactgagattaaaaaaaaaaaacgttcttgtttttatgtgttgacagaattacaggtacagaagctacctgttccataattgccatgtacttgaagatgccttctggaagtaaaaggtattttcaacaccattttgtgcttttggggtgaagcatgtgcatgtgtagtgtagataactaccaacaatttataacatatttttaatataaaaaagagaactatacattcaataccaataaacagatagttagttaatttgtacagtaccgtgacaagtttagctatagaggtagtttagattgatttgattcaatgaaaggagaaaaaaaaaaagtttagattgatgggacatggcaaaataaacaggattatgattaccttatagaaatgaaagtaattaaggcttgtacgtttaatgcgacaaaggaaaagaaaaacaaaaagaaattctattgtagtgtcttcgggagtagaactcaaatgatgcaactcttctttaaacaaacaaaaattggaagccaagataatcaacgatccctaatccagtatatatcttattcaccatagttagagaacaaaacttaaaagaaagaatttaattaaagtgtatatatatatatatattaactttgtaaagatatttattctggcatttaatcatgaataatcatatatcttattaaattttataatgatagtttaaataaacatagttaaaattatttttaattgacaagagtttaattttcataaattgtcagtgtaattcttttactatcgagatcagtcaattagaatttattatcaatataaattttaaaataattattataaattaataatatttacatacatgacaatttataattaaattataatataaaaatatatactaccaatatatttaaattaaattcgaatccttatggttaggcacatgcatattcaaatttgaacatttcaaatatcttgagagaacataaaattattttggatcccttactctcaatttaaacatcatgttatcctaaaataagtttgtctataaaatctataaaaaaataatatgctgtaaatgaataatatatatatatatatatatatatatatatatataatatgctgtttctactctctagacacatttacagctatatcaaccttttccagacacacaactttagggtaccgctttccccacctatcatataaatgaatcttgaagatgactgaagatccttatgccttatctaatttgaacttttatgactctgttctgtgcattatgaatctagcaattgcatgatactatcaaaattaatctttgccaattgtcccatctaccatctccttcattttgctgataatagatcgatggggaagtttcagctacacccactaatacatcatgaatcatcaaatcgaaactgtagacttaggacaagttttatttatgatatgcattcgtgtaatgtgtaattgacagctttggattcattgaattcaatagctttaatttaacggtttagaaccaaatagctgcttagatataggcttatagtccacattaatttgaccctaaacttaatcttttactaatttagagatggttgtgcataaaataatggaatttcaaagtaagcatattaatttattatgatgtatgatgacagaagatttatagaaaagaaaataaaagaaaaagtaatatttcatggtaaaggggagatcaacgaggcaaaagagggtgaataaagggaccccaatgacattaaaaagaagagacaaaaggcaccatgtatacatggatggaaattaattcttgcattagtatgaaacgatccatcctctaaccccaccattttattaattgtcggctttaaatctctttgtaaaaaagtagtcataaaggtatatatccaaccccaaaagaaaaagagagcaagtcataaaaggcttcccctgggggcatcttatgaacaatcaagtttacattacacatatggcatgatgtcatttttcacccaatagcaatgaaaaacaagaaggcccttttggatcacttggtaatcccatgcaagatgaattcagtaaatgaaaaagaaagattagacaataagaaaaaaaatgtgatgatgatttccacttccaccataaatttcttcatctctaacagagaaaatcataaataaccacagataaataattagctcctcttgaaaaatgtaattacgcaacacttctagctagcactcccatttacaccaagttatataattgttgattcctctatgtgattctgtcttaattaattaacatatcttataacccatttttaatttttctttcatgcttgcttgttaaattcaagaatttttttttttttaaaataaatactaattttcttttcgtttttcactgccccccatccacacacgcacacaccttcccttcttccttctgagtatttgaattccattatctatgtgactcataccacgacggttttcgacaaacatgaacgaaaattattgtttgtgtatatgaagaatcgtattttttaatctaaatcacattcctgctgttgtatatcgtactacatggatccaccaacatttgattaaaaaaaaacatgaggaacaagtcataagctaatcctcacaaagaaaatagccaggcacatgacatgaaacaaaacattgctggattttctatatatggcaataattaaaaatctaacctatacatgctgctgaggctgtcataatgtggtgcaccttatgtttagattgaagcattgcttatcaacttattatgatattcctgtccattaagattataatacccccccccccccaaaaaaaaaagctccctggttctccaatatttgtttattaaaagtgagtgtcaggcctcggctagctttttgttactttgggaaaacaaattaattgcataaggaaaagagagttgtaattatttgtaagataggtagcttctctttagtgataggttgttagctaggtaggagctcatgcatgctcatgagaggagaatatcgatcaataatctatttgaacaacatcagtggaaaattcaaatttgaccaacaatagagtggccacaaattataaatgtagtacgagtgtctaaacattattattagagcagcgcattagtattgcctatgaacacattatcaccactccattcgattacaatatgagccttctgtccatgcatgttcttattgtattgtcggaagccattttatcactgatatagccgcaacttctactactagtgctggaagatgggccattgatgtgtatgaaagaagctggccattatagagcatggtaattccacccatattattaaattaaagcttaatatgatatcacttacaagattgatagataataatttgaatcaatttatatgaaattattttaatttaataagggatatcaagtttaaatattaagtatctaattatattaaatatggtgaaggagaattttgttatttatattagtcttatttaatttgaagattgttttattacataaaaaagacatgtaatctctaagccgatttttatcaaattaatgattagtgatctgcacattaaattaagctctctctctttttttgtttatttatttatttttgttgttttgcctacctagtcaacattagctctttagcaatcatacaagcaagtgtaatcatacaataaaaacagaatggcttccccgtgccccaaattctggaaatatgagaagaatagagagagaaagatagcgagagattttatgatttgcattgaggtggaccctttgagaggtctaccagtatagcatcataggaacttttgtccttaatgcatggcacacgtgcaatagagtcagcaagtggtgaattcgatgcacatcaagtggacttttgaatccccaataataacacggattgatcgaaccaagcatgatttgttagtgacataataatgaaatcccatcaccataatattaattaattaataagccatatatagggtccatgggcatcaaaaatcatgtaagaagaattgccaagttacacttcccgaattcacacgtttgggaggctccatccctgatcaatatcacaaatcctttactgtttagaaaacaattgaaatctttgtttctttctaattatttggccaattcctccaatttgtgattgtttcccgaaatcatagagataagaccatataggtcgacatcctaagcaatttgtctataattgagatttatcacctaccgcattagcaaattaattcaatgtgaagggagcttagagaccattgccacccaatgagtgaatgcttaaagtcatatatggatccattaattttaattgtttttctctagatcttcactatactaatttttaaacctttcaaagtgctccactgagttttggcttgtttttcctccatgaagattccattattaaaaagactttgccatatccccgaacatagccttatagcttgcccatatatacatataatctttcttgcttgctttctttctttttttgatatattatacagaatatagtatttctaactccaataaaaaaataaatgatattaacctgctaatggattatatagtttggtgatacatatttacttgagttgtgctatttcgtgccaatagtttggtatgaaagaacgaatttgttactaatcaccaaataagaaaatatacacaaaatgacgaataaatgcacaggaaagtaaataattaacatcacgtcattttatattatctgtgcgaatagatagatttcttctcggttaaaagaaaaatatggtcttcaatttcagtctcattccaaagagtcagtttcactctacatattgttagcttgaaaaaacttcgtctttgataaaagatagtggtcctaaagaaaatcacattaaatcaagtgactgtttgatcatatcataattcatagctgtctaaatatatccgtaagttctggtttctgttcctaaatcactttccaaatgctataaattattatatgtaatgtgtgcatggaaagttagaatataataatatcatcctttacatatatgaacccagtactttgaacgtgtcctatcaactccacccacgagtcatgaatggtaagcccaggaattttgctgttagtactttgcaattaaataaactggctagctttgggtcttctggaggttagtggctttttttttttcttaaccattttttaaaaaataattatatttatattactgtgtttgaatttatttattttgaaaaataatattttttattttaaaaaaactattatttttctaaaaaaatcctcctgctgcatgtcagtcgtcaagattagtatgagcaagacatgcagggacatttatttgtcataactttgtttgaccgttaaaaatacaaaaaaaaaaagtaaaataaaaagagataaataaaataatagtttgtttggataaatagaaatgataaacgataaattaaaaaaattattttaacttatttagatcagaacatttttatccagcataaaaaaaaaagatcataaattttttatccttaggtaaaaaaaaaaaaaatggaaaaaatagagcatgttaaatgagaaatgacctaactattattttgtggatcttacgtaaagaaatctctccttatggtgtggagagaaattttctataaacctcacattggaaaaaaaaaaaaaaaaaaaaaaaaaactcctttcttacaaataattacaactcatgcacgtaaagtatgcacggaaaaaactcctttcttacaaattttctataccaattgagtaaaattacatattttatattaaaaaatatcttcttcttcttttcaaattctagttatgttgtacaataaatatattacgtaaagtataagtaaatatctataaaattatacgcccatgccagttaatgcgtaaatatcttatctattacgtactataatatttttgtgtggaaactcattgattttaagatcatctctcttcgttagagttcacaattaaactgcactcatcatccaatggtaaattagcttgcaatttgcaaaacaagttttcatattttattttagtagaaaaagaaacattttcaagggttgcaatgcatctttacagtgaaaaatttagcttgatcggatcatcttgttcacattaattatcttatatactttaatcatggcctatggtcgataaactagttctattcactgtttccattcatcattacaaagcgacctccttgccatcaagataactacaagtcatttttaagataacagtagttagaatcaatattgtggcgtccactgaaacataattaagagcgttgtctcgctaacttgttcaaagattcgtatgcgattcaaaaaataaaacaaagtcatgcagtattaattaattataaaccacgaaccagaataatttaacctataggtaatgtgttatcaaacaaaagtgggaccattacgtgcctaaagttttggtggtcttgaacctatagatttcaatccctataaaactaaaaataactatagagtttttggaaccattatatgtgcccataattttgattatatatattacattttagtggaagatatatacaatgtaatgatctccactatacaataatttcccctttgaaacaagtatttcactttaattaagaagataaaaaaaattaaggacttacataattacatccattaattgttcatattggttaaggtccacataaccttatatatatataatctgtcatatatatgtttttaaccaaaatctcaaccgtttagttatttatttatttatcaatcctcatagatcttcccttttatctctgacatacatgaatccttcacttaaatctaataaataaataaaaagaagccaaagctattttacattccattttggagatgggagggagccagggaacaaccggaagaaagcaacagatttccgtagcccatcaattagataatgttgactagaaaagaagaaagtgttaacttgcgattagaaagtacgatgcatgaatactactatttgtcatggtactcctaaatacttgtacctgtactaggcactattccgtaccacgataccagcatttatttataatgtatatataattagttacatataacattatgaaaaattgtatatatattgtgattgcgattttatactccatcattatatgttcttattttttttacatgaaatatatcttctcatgcacgtatcttaatatgtcttgtcaattttgtggaaccattaattgtacccgaagctgtaccaatggacttgtgttgtgttcctatatccatgcaacacgaatgaatttgttgtgcagatcgatctaggcggcaacaaacagtgaaatcataggaagagttggatgatcagcaatgttcatgttcatgggtcacttccaagtttcagctgacaattcacttgtttggacggaagaacatctttatgcatgggatttttgaatttaaaaatcttcccaaaaactattcccattttaaaaatatatatttttatgtctctatccccaattaattaataaaatatatttaagtggagtttattgtgagatccttaaaagtgactcaagaatccaaaatgtgatttatcttaaagtaaaaaagaaaaaattacttgcatcttgtatgacaccataaaactcacaaaaaattgtccaagaacctaaaattgaatctaccacgcactataagggtagattagaaatctcattccagcagatctgctagttcaaaagcctattgtaggtttcaagaataaactggtattattttagtttctgaacaaatgtatcgtaatactgttatataattactccttgaattctcacgcatcctcttcgcgctagttgggttaggactgaggagagtgaaaaatttttttttttttgttgacatatttgggcttaggtgcttttcggcccaaatcaaagtgaaaggggaaacacacttatttgggcttcaacgactcatccttcactctcccaatctaagtattaaccaaaatacttaattaaatctaacactagcatttaattgtctatacaataaaataaatcctaaataattatttaaacgcattttaatacttaaaattccatttttttaccatacacacaaattcttaatttacttaaatttataataattttctaaactaattgataggattctttttaattattttaagtcaaaaatataaatacataacaattatcaaagcatcaatagtaaaaaataaaataacaatttatttaatatttaaaaatacacgaaattagggaaaagaggatgccatacacatcacatatgataagagacaatatatatatatatatatatatatattactattcattatttttaagtttgataagaaaaagggtaaacttttagttcaaagtaaattgcatgtatttttcatttattccatgccaagtttaacctaagctttgataatatgaaaagatatcattcaatcatatagttaaaagacaaaaaaagagaagtgtaaatattaatgatctccacaaacacacacgtaacaatttattataatgttatatggagcacttgttaacactttgtcaagtgtaccaatttgtccaaataataattagacggtaagtccgaatgtcgatttcacatgacctttgtttgtactcagagttaatacacgttcgtttctaaacaattaattaatcaatttggttctttagagtaaatgacatataattaaacttgacctactaaactatgaagcagtgtaaatacaaataacaaagacacaaacactcagagtattgcagtgatggttgaaatacgatgcgatgtatgttgggagcttaactaatcgaaactaactttgatgcaatattaaagatttttcgctattcaatattattttccaatcaccttcatctactaatatattctagccatgattcctcaagtgcaagaccctaaatcacttaattttgctcttaatcccttaagagttgcattaaccaacttgcattaagattaaagataaacaacttaggctaaacaaaaccattctatccctagaaatggtacatttagaagtgtttttcaattataagaaaataacaattttccaatgtattaaaacctattacaatacatgaaaatgcatgatcaaaccactaacatgataataactcagaaaacaataataatgcgaaaatgacattgaatagataattagaatcattatatttggttgttgagctcccaacaatgggattctagcctcttattttcatatgagacttatacaaatggagggttaaggcaagggaaatggagtggatggagggaaatgaggaacataatgatgaatgacagctccaatggtgtggaatgatgtctccttcgtgacctaagtgcttgttttctgtctgtccaagtgttccaagataatcccctctttttccctcatatttttccttaaaacgcaacttagtgtcgtggtcacgcgcctagcgggacatatcgtgttaagcgtgcctttagtgtccagctggataaatgaccacgcgctaagcgaactagttgcgctgagtggatctctgcgcattgagcgagtagaccctcaattctccttccttgtccttgcagtgaatttttacaaaaaaatacaatcaacaccttatagtcaacaaaatttagcatctactggataaaagctcataaaatgactaattcctaagttttaatcgcaaaaagaagcattaaaaagagaaaaaaaaagagataattgttatgtaatttacatgtaactttgctatgcatagcaattatcaacactccatattagttgggaaagaatgagaaaaaagtgtaaaatataataggtggtgtgcatacttcttacttttatatttccttcactatctttagggtaatcacaatcaaattgattttgcaaaattattttttttaagtaaagtgatttatttatgattatagttttatttaaaatttaaagtaatagtaaaaattggtataattttttttcatctaatgtaaacctacctaaacatgctttaactcaaaatccattatgtgctcataaataatttttcaacatgataccaaacattggaacatttattttaaatcactaaaatccaacactttataaatgtgtgtttgattttatgttgaattgtctaaaatcatgttaaaatatcaactaatgttattttagataatcgttcacatattgaagaattgattatgtacacaaattgagttttaatttttatagacaacttttttattggataagaaaattttatttatttttaattataatttaaatcaattttataaatttaatttcactgataatcaattaaatgatcataaagcacaaaattaaattaaatcaatttaaaatgaaaagtacaataaggtccaacattattgattctttaaatatattggaagagatttaatattaatttttagtctccttaattttgtacttacattaatcaaaatttaaaaaaacacaaacttacaagaaaaaaaaacttacataaacctaaattgaaaaagtacaaactcacataagtttaaaaaaataaaaaaattatataaatcaaaattaaaaaatcataaaaaaaaaacttagagaaaccaaaaatatatcgtgatcctaactcttattttatatcttacctaatttaaaccatctttatatcatatattgctcacactatcttatttctcctatttatagagatacgttattgtaaggacaacaaactattattttttattttttattgtgatccttggtaagaattgcatgaattaggattactaaatctgtaattattagatttagatatatttaatattcatctgtaaacaaatttattaaatttcatcaagatcatttgatatatatttatttctattatatatgatatgaataatttgtaatctatcaaatctaatctaatggctgaaaacgaactaaaccaagtccacggcaaaacggtgatgcaagacgattagttggagcgtagaaggatctagaagacataaaaccctagccaacacttgctatataacttgccactttcttccattttctctaagcactccttccttttcgttctgttctagcatcttcgctgcaactctctaccttccctctttttccgaatttgaaacgaaatggcctcggagactgagacgttcgcttttcaggccgagatcaaccagctcctcagtctaatcatcaacaccttctacagcaacaaggagatctttcttcgtgagctcatcagcaatgcctctgacgtaagatttttatcgatccttgttaggtttttctatttccgtttgttgattacgtcctttactgcgctcgttctttattttcatgtttattgctcaaacacatgcagggtttgttggacatgtctttttccccccttttatttttttgtgatttctcttgcgtgcgtttacctgttgttgtcttcatagttcaacaattgatgtgtttttttttttttttttttaatttgttagggttcatgttatgatattgtgctctttccattgttaaacggtgctgattattctctttattatcttaaatagcataattgaaatttattgagtttcgggtacataatttttgtccctgttcctgttgtctctgttatgtgagatttacgtagtactatgccgtttttttttactgcaaccattggatcttgattgaggcaaaactgatgctgttaatacgttcttctatttggggagtgagtggatcgtttggatttggtgtgaattatgctttatttaggttttctcttattctacactttgggccttatatctgattgctgacatgttattacctttacaacaatgtaggccttggacaagattcgatttgagagtcttactgacaagagcaagcttgatgctcagccagagttgttcattcacattattcctgacaagaccaacaacacattgtctatcattgacagtggtattggcatgactaaggctggtaagattaaatattttgttagtctttgtgagattatcgcggactgtgcatgttagttagtctgttttctctaatgcatgtgcgttttatgttccagatttggtgaacaaccttggtactattgcaaggtccgggaccaaggaattcatggaagccctggctgctggtgctgatgtgagcatgattgggcagttcggtgttggtttctactcggcttatcttgtagctgataaggttattgttaccacaaagcacaatgatgatgaacagtatgtctgggagtcacatgccggtggctcatttactgtgacaagagatacatctggtgagaaccttggtaggggaacaaagatgactttgtttcttaaggaagatcaacttgagtatcttgaggaacgccgtctgaaggatttgataaagaagcattctgaattcattagctatcctatttctctctggattgagaagactactgaaaaggagatttctgatgatgaggatgaggaagagaagaaggatgaggagggtaaagttgaagatgtggatgaagataaggagaaggaggagaagaaaaagaagaccattaaggaggtatctcacgagtggtcattggtgaacaagcagaagcctatttggatgaggaaacctgaagagattacaaaagaagaatatgctgctttctacaagagtcttaccaatgattgggaagagcatttggctgttaagcacttttctgttgagggtcagctggagtttaaggctgtcctctttattcccaagagagcaccttttgatctctttgacactaagaagaagcctaacaacatcaaattgtatgtccgccgtgtcttcatcatggacaactgtgaggagttgatgcctgaatatcttagctttgttaagggtattgtggattctgaggatcttcctctcaacatttctagagaaatgctgcagcaaaacaagatcctgaaagtcatcaggaagaacttggtcaagaagtgcgttgagatgttctttgaaattgctgagaacaaggaggactataacaagttttatgaagccttctctaagaacctaaaacttggtattcatgaggattctcagaacaagacaaagctagctgaattgctcaggtatcactccactaagagtggtgatgagatgaccagcctcaaggactatgttaccaggatgaaggaaggacagaatgacatctactacattactggggaaagcaagaaagctgttgagaattcccccttccttgaaaagcttaagaagaaggggtacgaggttctctacatggttgatgctattgatgagtatgctgttggtcagcttaaggaatttgagggaaagaagttggtctctgctaccaaggaaggactgaaacttgacgagagtgaagacgagaagaaaaagaaggaagaactaaaggataaatttgagggtctttgccatgtgatcaaggatgtgttgggtgacaaggtggagaaagttgtggtgtctgatcgtgttgtggattctccttgctgtctggtgacaggtgaatatgggtggacagccaacatggaaaggattatgaaagcacaggcattgagggacagcagcatggctggatacatgtcgagcaagaagacgatggagattaaccctgagaaccccatcatggaggagctgaggaagcgagcagatgctgataagaatgacaaatctgtgaaggatctcgtgctcttgctctttgagactgctcttctaacttctgggttcagccttgatgatcccaacactttcggtaacaggattcacaggatgctgaagcttggactgagtattgatgaagatgctggtgaagcagatgctgacatgatgcctcctctggaggacgctgatgccgatgctgagggtagcaagatggaagaagttgattaaatctgacttaattgcctgttttgtttttagaaagaaacaatgattggagaaacagtcttttaatatgttttatgttttttgaattttcgaaattttggaatgttggctagtttggtgccgttttctggattagtagtgtatgtagtttctttatggtaaatttgtgtccgctctctggccaatgaatttgtgctttcttcggataaacgtgtatgctgattgcggaagtttcagttcgggaatgaaaatgtttttacttctgagtgaaattaatcgctttgacgtggggataagaggattggtcaaatgacacaattatgagtttaaaaatgtcattcctaattaactgtttatgatttttttgaacgtttaaatatttgtttttgtttttgtttttgtaattttttttaatccttatttacaatttttttccttaaacatattagataacattttttttctgtttaaaatattttttattatttatagagttatctaaaatattttaaaataaataaatatattttataaagactaatgaaaaaaaattatagaaataaaaattaaaagtgttaaattacagaaaaaaaaatttaaacctaaattgaaaacaatgttgttgaaaatttttgcatttttaattactttaccttttaattattttctaaacttactatttgttctctcaaactcatttaaaagataaaagaaattatagacagataagtgcacctttatgttaaatatgtaaggacctttatatccattgccactttcttttttatattaaaatttaaacaatgtctgaatatttacatttttgaaaaatagcattactccttgttataattcattctcagaacatttttgcgttttttaggaataattttattttataaatatttattttgctttgaaaagtaataatccgttaatttggcaaaaaacaggtagtaatccgtatgcacctataatcttatatatagggactttcaagaatgaagattggctgcttaacttctagcataccctcacggaaggtaaaagaatgcgctgatgtcttctatgtatatattctatctatataataaaatataataaaagaaggaaggggcctgatcagtttgaaaattgctaattacacctcttttttgataagtttctcaggaaaaaattgaaacttgctaaatgataagtctcgcaatcctaactgataagtctcgcaaccctaactgataagtctcgcaaccctaactaataaaagaaggaaggggcctgacacccccatcagtttgaaaattgctaattacacctcttttttgataagtttctcaggaaaaaattgaaacttgctaaatgataagtctcgcaatcctaactgataagtctcgcaaccctaactaataagtctctcagcaaaaaaaaattgaaacttgctaattgcacctcctttttgataaatccctctattaaattttgatacttgctaattgcacctcctttttgataagtatactccaatatttccttttaaattttaaatgcctattatgtcttttctttcatctctctcacacattctctctttaaagtgtaggcagtgatattacctatgtacgcagggtatcgtactaactagttgcaaaactacaaaatttcaatattattttcatctttccttatggagagactctaaaccactggtgatatagtaattgtttgttggtgcatattgcagggtatcgtactagccagttgcaaatttacaagattccaatattattttcatcattccttttagagagactcaaaatcaccgatgatatagtaattatttgttggtgcatcttgcattccttcactactacatcgataccgttggtaagtatgttttctcatccttttggtcattttcacctttcttattgttacatgtatttcatatttgtttttaattttcctcatttttgtttaatggatttcttgatatttttcatttgagaaatcaaaaggattttgtccaacaagaagtcgtgggtatgtgttgattctcatccatcttttttttatcattttcacttttgtgattctaatgtcaaatttacaggcatttgatgcatctttcatctctctcacaccttttttatgttacatatatttcatatttgtttttaatttccctcatttttgcttaatggatttcttgatgtttttcatttgagaaatcaaaagggttttgttcaacaacaaaaagtcgtggatatgtgttgattctcatccatcttttttttcttttcattttcacttttgtgattctaatgtcaaagtttcttggtgtttttaattttaacattagtaagtagtcatggcctcgtgggtaagtgcagttgttgtctttcattttatattatgatttctacaatctcctcctttgagtccttcatcttttgttatatatatatatatatatatatatatattttttttttttttattgaaggtttttttttattattttatttcagaagttagaagctctatgaactaattaaacacctattgttacttactatcattctttctcaatgttgttggttcttacctcaattagttgagtctaattattgatagatttacaaaggtgtgacaagagatgaagccttaagtggatcaatggcttaaggtctgatttcaagagaggtatattatcacaagaaaaaaaatcattatttaacttcatttcttttttttttcctcttatttttgctacacatccattttgtcattaataaactatgctagatcttgcattttttaaatatgtttccagtctagatggtatattgttttaactacatttttaagagttatgtgtgttcaaatatcttctttgagaaatatgacttcagctctatgcataatcaaaaaatggtaaaaaaaatattgataataatgtatgttatattattcctttttgtattttttctattctatattttattttattctttaacatatttaatattaaataatttatgttcactaaaataataacatttagttaatatatattataaaataataatttgattctttgttatataacggtcaaagttaattaatttaaattattttattaaaaatatcataaattaaaatacttttagttaatattaaatatcttttaggcatccattttcttattttttttaaaatagacaacatttattagtttttgtttttatttattaagttctaaaaagttacaaatgaatatatatacaattatattatatatttaacggatacaattaagtatatataattatattatacattagattttatgacttaagagtatgtccacacgaatactttactagttagctaaacgtggagcgtcttcgtctcaacatgttccagttttggagcagtctttctgatgttcaaatgcttctcttggcagatgctttactgtatgtttatattctgctagtttggttgcctattttattatgcggaatgattaaaaaaaaagatgacataatatttttattattattatttataaaaatccataaaatttaacagttaacatattatataaaataaattaatataattaataattgattattgaactctttttaagaagtttttcttaggccccaataattttagacaaggccatgccatgatctccgtatccaactttccaataggaaaaaataaataaaagtggttaatatattaaaaataatgtcaaattatttgtacagtatcagagtttaatccttgattaaaatacttattttttattgaatttcagattagtcaaaatctcttttagactaattgaacgttaaagacaaaaaaataataataaagtttggcagagtaaaagagataaatcaagtaaaaacttatcccacaaaaaaattaattataataatatttttgttattaaaaaacttattttactacacgtaagttagttaacatgagagttctttccattgaaactttgcaatattcacaacatattcaagcacagaagccaggcaaggctagtattgagatttgagtgagtggttagagctcattgcagagagattggagccaacagagctggcatggctcattcctgaacggtggtgccggcacctgaaggatccaacatgtgtggtgggtgagcatagacaattcctcctttcactcgaagacttcttcaatgcagatgcagcttgaggtgttggtgacacagacacaaccatatttgactgcttattgatataatccatattcaaaccaggtatttttatttctttaccattcagcttcattagattcatgcaaggggactttttctccatatttccctccatccctttcctgaccacgcatattcaattaagaattaaccatctaacatttgagcaaatcaacaactaaacaatttaacaagataactgcatgtggttggactttacattttttttttttttgggtgaatgactggggcaatcagctccaagaaactagcttaaaaaccacaagggaacacagtcgagcttacatctgccataacagcaggtaaaacagaatcataaacatgccaatcatcatctaaagacattggtaaaacagataattgcacggttggactttacataacagctgcatgtgttagattcttaaaaaatgtgttaactgctaataatgtcctatgccttgtgtctaaggacatatatgcatatgatggagatcaaagaagagagttagttaccttgtgatgcgcttatcttaatttccttgttgtgttatgattttctttggatgtgtgctatataatactactatatgatttgcttatgaagcaagatatcacgaattaaagacatggtacatgcataatgctaatgacataacaacaacattaaatcatgtttcatgacaagatgcttgattggtttccctcttatgaatcatgtatgtatactttgtaaatgttgattgtagggtgaagccatatataatataagtgattaatttatacctagatagttgagaaggcgtgtacaaaatatgatgtccttccgcagatgaattgcttggttcacttgaggctttggattctctgcaacaatgtagagagggagggcccctagtatgatattatgcttcctctgaagattcagaaaacctcagctcttagatagcacaaatcttgggcgttaaccatctcagtttcgttgtttcaaatatgtggtatttattcaatcaacaatttatggcgacaagttctcaaaaagctctgctggcgttttttcttctcaacctagttggacatgagatactatgactatgataggtcttttccttgatatgattgacaaattggcaataatttaacagcttccgtgacgctgtacttcttttggatattctttatttttcaccattttgattctttattgtcacgttgacaatcttaagctaattttacagcgataatgccttcttgttgcttgttgcttcatattattgtgctttttttgggttggtttgacaacttttaggctattttaggacaagaataacaatacttggataaatttatttagtagttggttttatttagttgtgaattttaatattagatatgcaaaataaatcatatctgttcattcgatatcaacacagcctacatcaatggcaatcaaaatattctggtagaaggccgaaaagtagcatgtgtacaaagactatactaaagagtggacatttttttttttttttggcaatttgtttagggggaaaaaccctaaataatggacattttattgtttaagaattaaggaacgaatatattacttgctttaattttttccctacagagatgcagatgcttatctaacagtatttagatgacaatacaagaaaaatcactaatttgaatggttatgggatccattccttacaaccaagtacacattatagttttggtcactggtgagctactctgtacatatacaaactcactcaagtgacacgtgtaaagtatattaaaccaaaatttaaggaaaagaagaagaaaaaactgagggtaatatcaagagtatacatgtgaccaaataagatcaatccttttgactgttgtttctgctatttctacctctctaatccttgtttgcaaagagggcaacatgatgtaatttttagccattgatccacacattttaggtggaacatatgggaacagggcaattgtctaacttcctctttgtctttgtacttggctaagcagatacagcattcctgtaagcacatcagaacataacaaatctatcaattcaatagaaattgaaatatgacaaatcttaaaatgaatggaacttaaaagcatacatccaaatcgagggtaaaaatgcccaactacattactagctgttaagtggctagctagctgtacatcaagtcaagggctagtaaacaacacacttgtcatttttgtctcatttagcttttagggttgcattacttgagctctattttgatacatttctccatgaaacacatgaagtgcataagttcattttaatttataggagacgtttaatttattttatctttctattttcttctagtaaaagtgcttgtagaaaaaactatccaaataaggcctagtctatatctactaatggtaccacttactgggtcttcattgatcaattgtttactgccttcagagccattgcgaagctctaactctacaccggcttctttatgtctccaacttggaagttgtgaaatttgatcatcagaagctcctttattggaagaggccatgttcatgttgtagccgaggagggtgctaattagtggcacacagcagcataacaacacaaacagtaggaaagggaaagagtagcacattgcattccaagcaaggagaatgatgcagagcacatggagctttggagcatgatgaaaagatccaaaacgtgagtcaaaaacccaaacatttcccatcacaaaccatatggcgaagaaaagctcaagtgaagtccggcatttattcatcaagtgtgacatcctgtacaatacagtgcaaattaaaattacaacttcaaatttcaaccaaaaaaaagttgcatggctctaaaaataaaaacaaaaacttgtttctctgattgagtcaatgacttctccaacatttattttcagtagggaaactctcaaaagcacttctgacttgtatccaaacaggtcttatatgaaagttatttcagacaatataatacaaatagagtttacaatttattttttaattcctaattggtactgttaattcttggaaatggttttcgtcaacttgaaattacaatacattttaatagaaaaagaagttggtaaaacttctatattagtcttttcaattttcacatgatttatatcctcaacgagataaaaaaaaatgcaataaacaaaagattctactctttcaaaagtaaatgccacgaactgatcgcagtgaaaaaggtatgtgagggtatttgattcctccaagctctttttaaggggataaattaaaattatgataactttatgattacttgacacttggtattttcctatcttctaacaatccaacttgttttgtccaaatattatttataatcaattcaaggagaacaatttatttttatataacagttatatttaaccaacaaaacgatggtatcaagcttttctagcaaattttagagcatactcatgcattagtacactataatatagccaataagtacaattaattacccattcctaataataaaattgtctgaaataaaattgttgaaggttgaagtgcacaggatacctggtttcttcattgtttctctgctgttccatatcagaaaggctgagagaatctccttgagttagataaatttgacggtagcgtccataaagtagaagcagattaagaacacagccaatatcataaccagaaatccaaatcctcataggccaaataggtctctccctcttggaaatagccaaagtgaacgttgtaatcgttatttggagaatcaaggcaataaactccagcatcatccaagtgctagaattgaaagggttggagccaaggttggaccttgatccattttggtaatgaaaaactcttctcaaaaaggcaaaccatctggctctagatattctcatggccatccgaaccataaaggaaggaggggtgacacgtggaggcctgtttcgagcactagccactctatcttctgaggcagaatttgaagaaaatggaaccatgctatactcttgttgtggatgaacaaggaagcacctagaattcattggaaatgttttcttttgcctgtgtgtgttgagaatttgtccaagacgtgtatcagagatcaagtaattgaatccagcagcagtattaatttcttaaaagcacaggttttcatcaaaagaaccttgaaattgaagcatcccaattggcaactttgttgatggatggaactagtaccttgattggaagatcttttctgggtctgcaccacctttaactcctagcaacataatcagacaaatatcacaaaaagcttcaataacatgatcctttcagcaaccacaaactgtagagaaaggttaagaataggaaaaatatgaagaggggatggagctgatgaagtgtatatagaagaggaggaagggaagattggtgtgaaggatatgtcaggaaggtgaggttgtgtctcagagggtgacaaagaatcgaactgctaagttttgctttgattcgaagggaatcacaaggtttggagggaacttaaccgttggccaacttcctctaggctttatttttatatgaagccaagctcagaaagcaattggacttcaatttcccttcttttctctccctttctttgtcggctaaaatattttgatccgtaatcttattttttgtttttgttttgttcccataagtttaatgtccattttttcgtcttcttgccaatattttgttaattgactgaaattttaacttgaatctaaaaaaataaaacgagggacccaaaagttattttaacattgtttgtttgtctctttatatattaaaagattatcacaaacgcagatttttattttatttttttggtgaaaataaagtgaagtctatctctctttgaaataaagtgggctaagacttaaaagttattatctgatactatacgctgggcatttgtttacattatggccaacaaaatttcaaccttttaattctttatatgataaatgaatcataaaacatgatttgaattctggcgggtacagttgatattttgggattatgtggtaaacggttggccacctaatccaaccaacagttaatttgtgtcacattggagtagtgtggccctccttgtgtctaggaataattgctatgttttacgtattaaccacacaactcctaagtttcttctttttattacatgttgtaaattgttctaattgaagaaaaatctttgaagttcggttaattaagagtaagattaaatcttttgtaattgtatagactcatacaggagcgaaactaggttcttcgctatagggacagtcaccctccgagtaaataaaatttactgtcacccatccccatgaattctaatattgacccccctccctctcgatgaattttactatttcttcttttttacgttgatgatcagtttatagttttatatttctaccagagttcttggtaatatctgtatcttattttccaaagattccagtattatctagtcaacacgcgtataaattaaaataataaaatttgatttcaaatattaactaattaattatttcatatgctataaataattttagctattatagattaattgcttttaattacattgattttttggtacaggttcaactatgttaattattttcgaatatgctttatcatttatttagtaggttttaaattaatttttttattacattttaaattactcttaatttgatagataaaataatttaattttgagaaaaattatttttttttctatgaatcattgtcaatttatgtgttaaatttttgcctctctatcacttttttcctgattccgccactgacctcataggtggcctaacctaagtttaaacagcgccaccgatattttttttcagatgaaaataaggaaccgctagatggtttctaaagatgattgaatgtagagttgtatgagtacaatattattttgctacagtgaataagtttatttttactaatattataggtctgtcaaaaatgtgtttggctaacagaacatcagttgcgatgatttctatagtcgttagtttgactcataaattatagtcgtattaggccataactaatattctagaatcaaaattaacttgtgggatcacgcaagccgaatgggtcaccatccgctgattaatgtaggagaaagtagggctagcagaagtaaaaacaaacaaaatttgatcatattgctaagcaattattggaaactagatatagacctatgcattgaacatcttaaattaattttttctattgatttttctatttcttcgtatgtggtcattttggtgcatacatgcacttgatgtagagctagtgttagtctccatttgttttagtcattcaaaaagcataaactaattaaagagattaaaattacttaaaaaaaaaagagatttttttggttacatgtttttttttgttacaaaaaaaaaacactgcaacgtagaattgatcattgatcagaccactaaaatattaacattgcaacgcacaccttggcccctaaaaggaaaattaaagtatatgggtggaaaattaaaaggaaaaaagaaatgaaaacgtagaattgtcgacccaaactatcgattatacctaattttctatttggttaccataaatccaaatcaaacgtgggaaagcctaaattagaggccaaaaatttgacggctaaaggtcaaattcatgcgttgttaatttacgaatggagcaaagtgtaaaaatttcaaatatacattttatatgatccttagttctaaatagatcagagaaaaatcattttgggatcaatattaatttttaatttttaaaaaagaaaaaaggtcgcgtcaagtttaaaatcaacataaaataagtggccttaaccctcacgactaaatgctgaagagctactacataaaaggaaatcagagagggaatctataaggaatgagcgagatgtttaatcagcgtgataattaaggttacttgaatgaataaaattaaaccatgcgttaaccattaagaatttggcaagtgttgctgaagtggctatattccaaagaaaacatataattaacaaataaaagacgtcgattaagtttgttttgacgtattaggatcaaatttgaccccaatttgggcggtgagacatgcaacgtgttagtgttgacgtatcttgcaaaggaaagcaatcactttcggaaaatggataagaaatgggaactgttgaatttgaacacgaaacttatcttcatgtatacacggagaaatcaaaaggcttcaaagttgaagcaaaaaggttgattacgttaatttgaaaagtatgcaaaatcatcctcaaaatttcatgtgcttgccccggttgtcctcgtaccaactataaattcacaaaacttctaaaccaaatttaccatatgctgtgcatcaatcacaaattatattagaatttacttttacaataattattgtaaaaattacaaaactccaacatcttgattaaaaactatttgactttgaccaacttcgaacagtagtacatttggatggttctccaataaaaggtgcatgtcacattctgtatagtaactaaacaattgcttgagttggataggttagatttgtacgcgcatacaaatattcaatataattgagtaaaagtcagtcacatacatgcagcttccgatttcaaggcataattatacagcacgaatttgttttctcttgtcaattaagtgtatcatcgttaaacagtaaggacaaaaaaaagttgttgctagcgggggtcttaattaccgacttcgtctatcataatattgtgcacaatagattatatttgaactgctttttcagactgatattcaagttaatgatcaacgaattacaacaactggtctgcaacaaaattgactacaataattatatggatttatctattttcaatttttatataatagaaatataatttattctccccttttccatatatttttaataagattttttgaaagttctatcatattgtgtcccttaggtaggatcatgaggtgatctttaagaaccaattaagctcttggagataacaaaagaaatcagaaataacttcaaccgaaagtttctgcataatacatcaaataatactgtaataggacttaaggttttgttctaaaaggaacttggtgggtctacgcaggccatgggatgtacatacatatacatgcgtgatattaagttcttgacacacatgttgcttgttacaaaattccatttaaaaattccgtgagtgttatttagactcctcactcccatcccatgtgtttcttgtgctctgctctttcgattcaggataatgcttaattatttacacctcacgtggcacttacaaaatatatcatatttatagcatgtataaattataacatatatcctacttatatattaaaattttatattatattgttttaaatgaaaacatgtttaaatatcctatttacgtaatccctaattttttagaattgtagcgtatatttttaacccgcacaacacatggataaatatcaattttaaattcaatttagccattatgcaaaaacaaaatcaatttaatccttatttgtaattatgtcctcactgattgctacatttatatcatcatttattggaattacaacaaagtcaaatgtagtaactaatttagttacaacaaacctaatcatttaaatttgtaattttttttactaaaatgtatcaaaattaaactatctttatgtaaaaacaaacattttttcctgcatgcaaaaaaaacttaaaaataattattctggacattttaaacatgtgaattgtgaatatctgatccaacgtaaactttgtgtacttatgtgcatattttcttaggtccattgaaaaagtatgaacagttattgaaaaagtatgaacagttagactttatgtctgacagtaatagtagctcttaataattagacaaaaatagtttttgtccaaagtatactttgatttttcttaatttcagttctaggaaaacaaactcctatgttatcaatcacaataatcaaatgatatagatgaaaagaataagtacaaacaaatgacggcctagacaggctccactgctagaatggcaaagaacaatgtactagcactctaccagacatcttcaaccgcaaaaatatacagtcatagacacaaatagaaacctaatttgccttctcctttaccttgtcatcaggtttgcccaaaacaaattcagcatataaatccttcagagcaatcatgactgtagttatcaatggccccaaaatagctccctgtggaacaacagaatccttcagcaaatgttatgaaatacgaggaaaatgcatccatacaagttcactaataagccgacccacacttgagctactacacctatacattggatcccacatgctcacacacaaaagttacacaagcagataaccatttcaaacgaagttgtgcaggcaaaccagtctaaattctagaacaaatataggttagaaatttcatgttaatctaaaaaattacaatgtaagactattagtagttcaaattgagtaagaaaagagtaaatagtctatgtacactggtagtataaagggtttttacattgtcatatatgataaataagtttattaattttttttacaataaagtcatacctctatgagagtgcataaaaattaaacactaaagaaaaatatcagaatatcaaaacatggaggggtaacaatttacctctagagctgatggaaacaaagccattcccccaatgatgctcagtccagtaagatatgcactgtgtccaggcacatcttcaagaatctcagttgccccataatccatgaggaaaaggtgagcaacagacaagaaaatggccactatgtatctgccttctagtaccagctgtagtgttgctggaattgttgcaagccaagatggaaatattggtagcaaagggctaaggaaggcaatgacagttgacacatataagaaatgtattctgtatagcctaaacaaaagccaagtcaggcatccttggaagaatgcaatctcagcagtggccaaaaggactcctgaaatagccttatccaacacttcaacacacctgaccctggccgagtttgacatcggaaccatgttcatcacttgttctgttgccccacctgactctgatgtgatgagataatacaaaacccagaaaaacaccattgcctgagacacaaaattgaaaacctccgcagcaccagagactatggaattcaaaatggagatcacaaactttgcaccacttccaagcacacttgtaccactagccaaaacacgctgaccaacatccatccctttaaccgcatacccttttgccttctcaaccaaatcccccctagtaattataaggtcttggaaaagggtatcaagttctgcataaatctccccccactccttattcctaaccctacccttcaaactcaagagcttttctgtgtatggtgaaggcaccattaacgaatccgttgaagaagagttagcactagcactagcaggagcagttatcacaaactgcttaataaccgtcacaaattcagtcagattgtactgcattgccaacccatcaatctgatcagaaaccgtctcatagaactgactagtgtacttatccaccatcccagcaacatcattctcctccatccacttcttcacaccgattctctcagcgtaattgttctcttccactcgaaccttcagcgaaatcactgcctctttcccttcgccgccaatcttgtaagagaagaatataaccccactcaagaacccaacaatcatgccaacaatcaacccaacagccacaacggttttcaacctcttcaatacccctcttgtgaaaaatgcaccagagggaaagaaaagtgagaaactgaaatccacgttcttggaactgaaaacaaagcctaatcctagaagtgacagagacccaacagcaccaagcctctcataagcagcaacaaacaccccaaaggacaagagcaaacgaagcacggtggaaaagccgctacgcttctttgtgttgtcattctcattctcaggctttggcttcctgagaagggttctgagagaagcttcacgaatctcaacaagggttgtaatgaagagcgtgaagacggtgaggggaagggcgaggagggtgtgaaggaggcctagattgagagggtgagaccaaaagcaaacggtggtttggtgaatgagtctgagagggatggaacagagaacagcccattgaaagggtttgaggtactgttggaggagtttgtagagagagaagaggatcagaatggccatggcgagcccggcgtgggccatggctatgtagagggccaggcgcgcttgagactgagagtcgccggaggggttgactttttggtcggcatttgacggcggcggcggaggaggaggaggatcggaggtgggttttcggagggatgcggatcggaacatgtcgtgccacggtggggtggtggtggcagagttagggtcagagtaagggacaaggtccatctaagaacagaacagaaatagtagtgaagtgcaaataatgttagtgaatgaatgtgttatgttatgggtgtgctggctaaggatgttgtgtctgtcagtaaggattgaatggctaataaaagaaagagatacagtaatagtagtatcatttgatttccaagttttgtggtaaaaaagtgaacactgcagctttttaaactgacaggaagtaatagtacgaactatgaatatgaagtgaaaagattggaaaaaaaaaaaagagaggaagaactggtacttggcttcgttcgtgtcttatgttccattgcggcattgcattcttcacgtgcccgcaagtcatcccaatcttcatcataactaaattagtatgagatttcgtaagccattaattaattaagtaatcactaacagttttatcttatatctttaaattactctactcacgaacaatactgtaaagtgtatatttttttcttttgtttaagtaaaaaattaacatgtaattcttttcttttaatcgaaaatgataaggaaattattgataattttaaaagagagttttatggaagaattgaattataactcaataaatttaaaatttatttttttaaggatgagatcaataggtacttttattatttatttatttaaataaatattaagatgtatttatttttaaaaaatattagaagagacaaaattcaatgggtctaatccataactaatttataaaattgaatcttatctatcttacaaatatatcaagggataaataattgatccaattattagattttttttaaggctttaaaagagtcgtattattaggtgaaaactttatgtccaattctataacaaagattgtagcaataatgtcatgaatgactaggattatctaatttttttttttttaagtataattgatatagtttatgcgcaatcaaaatataatttttggggtggaatttctgccatcaacctatggatttgatcatttttctaatatcttctatagtaaaatgtgaaaaagtacctaatttaacggaaggggaagaagaattaaaatatttaatgtatcataatgattaaaatgtacgtattttaagtaaaaggttgataaagtatggggcagctacttttttttttttaaaaataaatttatagtttcttatctacatttttttttaatttggttgctaaagtttaaaaatttattttatttcctttaaaatgtttgttagaacaaattgctccttagtttttgtcaccaatatgtcaattttggttgatatgacatacatttatataatatgacatttttcaccgtttgccacgtattactaagttaataaattagtatgagaaactaataaaatggtcaattcagtttaacatagacattttaagaaattaaagtgatagctttctaaatttaagagaccaaactgaaataaaatatgtaaataagagatcaattttttttttaacttttctttatggtatatgggtcaactaatctatgttacaacagaagaaatggaagaaaaaaaaaacattaatttcatttgtagattgaagcatcaagccgtaaaaaacataactctgttatgaagcacatttctttaaaatggttggtacttggtagagcttgaatacagtatttattttttcttgcattgcgttttttcggctactgtttatcctgaaaaggcaactagacagtagacaccagcagagacacactttttttctcaaatgttgctgtttagttaacaacagcatagaagacatgttgttcatttcatgagagactaattgcaaatgtcaattcttctgcggagacagaagtaagctaacacgcggaagcatagagccatggctaccagaacccatgcttcagttaagcctccttccaagtctacagtgtcaaatgatggtgaactctgcagtgtcctgcaccctccttcgctttcacactcatatggttgctctcctgaatactgcacttttagaagtagtctgaacccatagtacacgaacgacaaatacttcaaccaatgcatcatcttcggtacgtgctgcatgcaacacaatcaagcgttctgtgaaggaaggctagcttttgaataaaaaatgagtacaactcttaccaaatgatcatgcatgaatatgtcacttccaaaacaaactaattattggtttatgtgtgttaaggcatggatgtgctgacgtgacaatgcattaacatatgaaccaaaattgtacaactaaaatagtagggattaaattcacgagaaaaaaaaaagatttgagaggcaaaattcgtgaaattgagaaagtagggagacaaagttgcagttaagcatacaaattacaatgttgctactccttgtgcatagcatacatacctggacatagtagccacctgtgagaaggaataacattagtatcaaagaagcaaccatccctgctctttgaatgctcataactgcagctccaaatagttctcctgccccctattaacaacattgtattcattaaagcttcaaacaaaaatgataacacgtcgtttacttattatgagtctcaacatagcttacttgacttgttatagctattaaaagcaccgcgaacaaagtcaggaagaagcaagcaacagtgctcttaaatccggccatgaagtacaagattaacatgaaaaaagtagggtagaaaacatgtgccaccatgtcacacagagtgctgcttgcatagtacacactcagtctatacatgtctgcttttctttctttcaccaagtaggccttttcaaatggaaagacatagactgctccaaaaatacatgaagatgtccagaatatacatatatagaacattaaaccaacctgcaccaaaaatagtagttcattctaatgttaatgttgaagagacaggtagagcagctcagccttgaaaaaattgaaatcaatatcatggaaactacctgatctctaacttgagcctctgtattggtagaagatttccaccaaagtaatcccaacaaaagtgcaatgccaagtgcttgaactagtcttaatttatcaaaatagtccttgcttcttgctttgaatgttctcttataaagaataacgaattggtcgcaccaactcactgtccagtcccttttaacctgaatggctagctgaagatgttctggtgtgtttgctgctccatgattctcttctttttcttttggctccagtgtgtctttgtacttgagttgtagatactaacataaaataaaggatcaattattaaatagaaatgacatagaacaagcatataagacttatataatacataaatctaacgttaataacagcttttgaagagtcagcagattcttgatctttcaaaatatcttgtcgaacgcttatgttattcacttgtccagttgccaagtcaagcaagaactctgcaggattcattggtatttccgggatgaacctcaaggatgaaaagtactgcattgagtccttagccttcccgtagtaaatgggatagccttctgatatcagaagaagtttgtcaaacatgtgaaagattctgctggatggctggtgaattgttgtgattatggtccttccaccctttaggcaaatcaaaagtaaattgtggggttatagaaatgaagcatgttatcaaaatgacagttaaatatagttactgataccttggcaagcccctgaagagttagaaggagtctgtttgctgaggtggaatcaaggcccgaagttggttcatcaagtagcagcagtgaaggatcaacaaggatttcatagcctatgttggttcgcttcctttctcctccagatatgcctttcagatatcctccacctatttttgtgtggcggcatctatgtttatataagagattatttagggaagcagttttatttcattctttgcttgcggcttactcgaaatcataataactaatttttagtcaattgtggaagattcaaagaatcaattaatgtaacacacctttcaaggccaagatccttgacagtgttctccactctagcatatttttgttgcttgctcatattgcttggcagtcttaagaatgcagagaagattaatgtttcctctactgtaagttgtgggaaaagcacatcctcttgtgtcacaaatccaatcctataagtcagaaaaagaagaaaataaaacaaaacaaacagaagagtgcttatgttctgttaaaatataaaagcacatgtcatgacatggatgctgatgtctatgaagctttctaacctcctcttgacagctggattaaatcgaacatcattataagttatcttcccctgcacattgtcaattaatcttccacctataactctcaacaaggttgttttcccactaccagaaggacccatcaaagcaagaatttcaccagggccaatgcttcctgtgatactcttcaaaattttcttgtatctatcttcctccacgtggtgttgtgtgcctacttttgacatcattgtcttcacagggttcttggaagccgcttggctatccctcaccttgaactctacatcttcaaactgcacattaatgagaattttgagagcaaatgacagtaatcataaatacacaattaaaacactgttgatgagaatattcttattgaaatcaattttcaatatcaagtggtaatcatcaagatcctcaatagcattgcatgaagaactatgattctcataaaaagaaaaactttgctctaatgcaatcgaagaaaataacatatggtccatgaccatcacaagtccatggttctggccgatttctatgtaccacacgtaaccgaattttcttaactcttgtaaattgaaaaactcgattacatgccacatgaaaattggccgaaaccatctatatgtggtggtcctgaaccatactataatttctcctaatgcacgtggaaagaaaattctaataaagttgtagaatttagccatttttctctaccttgagataaatggggagggggggatcttggtcgaaactgaaatcctcaacttttatgtcaatctctgtgtacatatttggaaggtatgcctgagacatgaactccatgctgtgaccaaagccattgctccctgcaatctgcatggagccaatagatggaggtgacattgacatgtcctcaatctcatcttctctttccttctccatgatcttggattctatgagaactttgttgaagccaggtagtctaataatgtagtttaattagatatatcgtgagtcaactgcatcagaccaagaccttgcctatatattgaggcagaattttagttggtgggccacgtacttttcatgacaagttcttggtccatgaaaggcatggatgttattctcacatatcctttcaatttaaccattatcatttgtcataagaacatgtcaagaacatgaataaattggcttggtaagtaattgaccattaatggaatacacgctgcatgtctttaatctcgtgtctatcaaattgatgcaattcgtctcattaaaaaaaataaaaatagttcatttacaatgaataataggctaaattatgtgattgataacagtcatgtccgtaacggcaatgccattttgtagattcacttctctttttcaagtgtttggtgctttgaagaccatctaatatttgtcatgtatactttttactcacaaaacactgatgtgtaaatcagtaaatctatttgacgactcttttagtgttgtgggatggtcaaccggagtcacgggtataatttgtagacaccttgttttaagttcaatctattgttttttaattatgctcattaatgtttggttgagtaatatgtgataatattgtctgaattaatcatggtcattgtcttgttattgatgcaaacaatttaatattatatttctaaacattctaagtttgatttcgttaaccattacttcaaggcataatttaattagaaattaaaaatttaacatttaacatttaattagaaattaaaaaaatattaagaatgtaacattaaatgttacaaatagatttttggtgtcgtcattttgtagaaagcctatgatttattgacttttttaacaatcaatagatgataaaactattcttaattttagataatattaactttaatgcactgttgagagaattaacagccatagatgtttattaaaggcatttcagattaatatattatcaatcaattctcagaagattcaaaaagaaatatatatatatatatatatatatatatatatatataagtgaaaaatatgtaagatatgataggaatagaaaaactgaaaaagaatatgtatctaactgatagtacagtgaagcaagtagcattaatcaaactaatttgttagcagtcacagtatagcagagcggttgtgttgggcccaaaatctgtgttttctgtcttgatttggttttttcatttcatgggtcacccttcatgcagtcatgccaccatattcactttgacgttgaagaaatttaaaacgaaaaatttactagtaacccattttatcgtaatttttttaacacatctctaataaaaaaattattattacttctgtaagactgtaactattatccttaagttatatttcctctaatttcgtatataagtaaaaacaactactttcatattgattaaaaaagataattaaaattatttaattttattaatctcaaataaaaaataaaattatttttaaaatattctttattagaacttgatattaaaaataacatttttacttataatcagatttgcttatacttgagtctaaaataccaaataacatttttacttatataagtcgagagaaaatatttgatgatattaaaaatatgatcatatgatcactaatgcacctattagaaacttaagtgtgtttgagaaaaggttagcaatactaattgatccctttacatttttggggagcaatatatatacttgaaggaaacttggggcatgtggactcgctttgtcaataaaaaaaattcagcaaagactcgacacaccatccttaacctttcaaatgaacaacggaatgaaaactacctgactctcacacacaacacgaatccatggacttattaattgaaagtataaattggataccaaaatttgcaccctgtcctgttcccaccctcggaaaatgaatgtataacgtaaagacattaatactttgtttagtttagaaaataaaataaaaaaatgagaatggattttttgttttaaagttagatgatattttaattgtttaataagaaagaaaatgaaaataaagttttatatgtgttaagaaaaaaaagttgtatctaaagtgacataaataacctaaaaagagagagaaccatgacaaataaataaataaaatatcattttagtccttttataatataaagcttactttcgactcttttttttctctaatttgggcaaaacaaatttttggtggtctcaacaaaaaatttcttgtttctttgtctcctctcttttcaattcaaccaaagagagtgtaacttttgaatggaaacaaaaaaattgtaatttaaattaaaggtgttacgaagtagtttgagtccaattcgtaaatatttttttcatgggacagtatgaaattacaaatgttagtaatgggaaagtaatttatactcatgaatagtgaatcatttcttgttatgagtaaaatgaccttgccactgaatcacaataagatataactgtccatgtccatgagagattttggtccctatttcaggaattcaacctacctgatggctatctataccatcaatccaaatgtagcaaataaaatctaaattacactaaacttgttagtatattcttatatcataaatttgaatcctcatacgtgaataaaagtatttttaatatattcttatatcataaatttgtgtgtgtaaaatttacaaaaaataaacattttaaaatatataaattatattgtaattcaaatcatactaaataaatatatttaataaataagttatattttagatttatatgataaacaattatatgatgatacaagattacttttaacttctgataatttcttttaaaaattgaaatccaatttagaaataaagataataatataaattgaaagagaaaaatgattaagaaaagtcaattatatgtatattgatttaagatggtcaaaagagaatttcttttcacaagatattaagccaaccatctcaaaacactctctttttatatttatccatgttttattaatcatttatctcttttaatttattttctatctttattttaaattaaaatttataactttcaaaagaaattaaattataaataattcaaaataatcttatattacaatataaatgtttatcataaatacaaactataatttatatagtaaacaatatttatttactataaattctaattataatataatttatattttcaaaactaatcattttttaaagatttaattaaataaaaataaacatttatcccatataatatatggactaaaatactagtttaatctacaaaagagaaaagaaaaaaaaaagtttgcattactttaacggttaatggtaccaaccagttggtaggatatcttcaaatctgcatttggatcagttagtaagatggaacttttgcatcaagtttagtgatgatatataccttatcagaaaagacgttgtatccatgagattaggcaatcttacctaaactaaaagcgtgcatagcggtcgttgctacaagtgtcttgactatttcctaatgatataacaataattcatgatgttatattaacttcccgtaaatcaacagttacatcaattcctagtataccagatatcatagacaggtgttgcatgctagtagtaccttcttcagctacacttctagtaagcttgaattgagaaacacgtgttgccaaattgttggcactctcatcaaatgctaaattctcttggaacataaagcaaattcccttcacttttctcttttgtctttttattttttttattttcatgcaattgaaaaacccctccttgaagaatgtcaattttctgtttccccataagcacctaacatacattgattgtattttaagcaacatggcctattaattcatatttatatgacccttttttctctttgcctttctgttttggcttccttaatctaattggtatagaatagtgttttagaaagagtgtctagcatcttgaataaatatgtgatccaagtccatgaataggccagattgttatggggtggttggattcactgtggggaagaggacgaaagtttattaaaaggaaagacagtgatgctggcgatgcaggtctttctgaatttcttagctgatttcattgtgactcagttttatttcatgcaactgagtggttttatatctaatttgcataatgtacatccaacttttgtttttacctatgttcatatattgttttttttctttttctgggattggcttgtgaacttttcatgttcaactcttgatgaatagatcccaactatcttaatcttacattaataattattttcccctgctcattctgtgtgaaatactattcatcgtttaagaatcattggatactccggccttggcggttgtaaattataagtttgttacgttactctctctctctctctctctctctttacattcataatctctgttgtttatgttatggttttactgatcctagaaactttctgagacccattttgattttgaattgaactgatacttctctgtttatttttctgcaactttcattgatgttctcagtagccaattaaaaaaatgacacttgaaatgaatgtatgaatttgatctaatattcatcttgttttcattcttccttctttggcatctgcccttatgctccattcttctttttctgttaagtgttgaactataatgcacttcttttatttccacagctgattagaactcaatttatttgagtcttctttaggcaaaattctcatgagtatttgtaggagaaaaaataaaataaaagaaataaaacaagtttctccattaacttatatgtaaaaagtattagttttttcaaaagttgattttaactttatacacaagctaattttgtgccctggagtaatattggggacatattcaatgtttacaagtttcccttttgcaatgaaatgattataagatattactcattagtcattaccattgattccaatatccttgatcccaataccaatataaactagacttggtgtacgctccagctaatgattgaaactatatcaggtagagcactggaagaactcagagcttctctctacaatgagatccgaacctcagaaggagccaagcgccaacagcaaagatattgtggaccagtggtggcactgtccttcaattttatggttgctgttgggattatcatggcaaacaaattggtcagtacaatttgcttcttttctatcatgtattatataatgtgatgaactgaatgtcccaactagtcattacaagcctattgattgatcaagcacccttacatgtatatgttgttaacaggtgatgggtaaagttggcttcaactttccaattttcctcacatttgtacactacatcactgcatggcttctccttgccattttcaagacactctcagtgcttcctgtgtcccctccatctaaaacaactccattctcttctttatttgcacttggtgttgttatggcctttgcctctggccttgcaaacaccagcctcaagtataacaggtttattcacttgctttagcatctttatgaattatgataaaaagatttggaactttactttttgctgacaatccagctcttgcagtgttggtttctaccaaatggctaagattgctgttaccccaacgattgttcttgcggagttcattctttttggaaaaaccattgattttaaaaaggtgaggaattactcttcttcccttctttttcttttctactcttttataaagcatttcacatatcttaaaaaggactattccaaccccctttctttgtttttagtgcactaatcatgtatgtcattgcaataatgcaggttttggctttggctgtcgtgtcagcaggtgtagctgttgcaactgtaacagatttagggttcaacttatttggtgctctaattgcaattgcatggataatcccaagtgccataaataagattttatggtctactttacaacagcaaggcaactggacagctctggcgtaagtaatattaattagagtacatttggaagagtttatttgcaacttatttggacttatcttgcaacataaatatttgtattagcatttgacttagtttatgaaaataactttcaacttatataaaaactgtttagccttggtttctcttcgattttatacataagcatgatacaacatttattcaagaagtgcttaattaaactatttacttaaaaacttttgtgattgtagattgatgtggaagacaaccccgatcacagttttcttcctcggggcattgatgccgtggatagatccaccaggagtcctatccttcaagtgggatgtgaacaactcaactgcagttttggtatctgctctccttggttttctcttgcagtggtcaggggcattggcattggggtactgagattacattcctcttccaacaccattttttgacatataatgttgttttcttttaatgttagataacatcacactatgaatctatgattgcagggccacttctgctacaacccatgttgtcttaggacagtttaaaacatgtgtgattctgttgggagggtatctattatttgactcagatcctggggttgtgagcattggtggtgctgttgttgctctctctgggatgtcagtttacacatcattgaatttgcaagagcctcaggagccttcatcgaagccgaaatcaacaagtgaagacaccacatctacagattcaaatgtaaatactactaccactaccactaccactacctctagcacccttgtatgtgtcatatagtagatgatgaatcatgaatacaagaacaccccatttttcagacaccacgtccttggttttagcaattagcgaaactttatgtatagacagtactggaaattcgttgagattttttaagggtagcttgcttttcacaaagttccatcaatctctttaatttcttaaatgaaaaaagcattatcaactattcaactgaatgatgttcaagggctttggctttagcacacatcttatataagttcgtcgaccaccactgacacactctgagataatgacttattactcaacagatgacatgtctggttaagttagaaaaaagaaacgagcatggtcttgcaaatggaaagccacaaaaaacagaggagtttccacgataaatttagccgctattgtattcattatttagggaatgtaacaaatcgttaatttcgaaggtttaactcattttcacaaagtgaacaagcagtagaatcattacaccgtctataatgtttttgatggtagagcaactttgtttgaaaatgttacattgtaacctcaaatcttatactaacactttataagaaaggtaaatgtaatgattaaaaatgtaagaaatgtttgtataaatacacaaaagctcaagtgtatagctgtaattttattttgatattaatattaatatcataaaattattatgtggagattttttaatactttttaaaattttgtatattaattttaaaatattaatattttgtttaataatgacatccatatatcaaatgataaattactatagaattttgtaataaaaataaactttgaatgactaaattattaaaataaagtatatacataatataagtaataatgttagtaacttagtattattataattcaaattaatattaacagttcaaatcaatattattttttccttgattaattattcagttaacatatttttattttatttttaattcatttaaataatacttaacaaaattatgtataatattaagcataaacatatttcaaaataacattaaaaattgccattaatagaaaagtgttatctacataacacaagtcaggttggtaattgtattcaaactctttttttcttttgaaacacaaagccgttacatttatgaaataacagtgtcgtaaatacaagtattaaattaaaagtctgagatttagcataaaattacaccaaataagttatgtaataaaacatctgagatttagcataaaattacaccaaataagtatgtaataaaaattctgagagctagcgtaaaattacacaactgcctaataagtgagcaacgtaattaacttgcatccttgcacaccaccctccatggtactcaaactctctttagaaatagtttgacttaattaaacatttcatgtctctagtttctcgatttcgcaaatttcatttccaaattttctacatgaatatgattcttcactgttttaatttaacatctaataaccaaccgaaaatataatgtcgcattatttagatatatcatatttaacatctaacactcgtgaaaaaaaaattggaagatgaagttttctagattaaatatatgaatttttttggagttactaaacatatatgatttggtaagagttcatctattaacatctaaatatttaacaaaaaatactaatgtaacattgtcacatcaacaaatccacatatatcttaatatcacatcaatattatcattaaatactcaagttaattaatagatcaaaattacataattaaaatattaaatcaaatttgcaaaaaaaaataaaaatgcaattcataaaattgagaaaataaagaaaccaaaagtacaataaacctaataattttaacttataccaaacacattagactataatttatcattgtccacgctcacgtaatcatgggatcaagtatgcaaattaacatttttttttttgccttttctaaatgagggataatggataacaagttaatacaggcaccaaattgcacaatttaaaaataagactaaaatcgaataattaaaaattaagacccacatcaaacttatgccagaattccaactccacatctatgaatgttaacaaatgaaccaaaatttacaaataaaatatgaaaaaccaaaatcacctaaaaaactatacaagaaccgaaaatacaattaagcccaaattattaagggtataaataaataacattgaagggaacagaagcatataattctatgattcccgataatttttaatgcatatgaactattaaggtttcaagaaagctgtcacacgagacctgtagcaaacagtaatttctcaataattggatgtgttgaaagaaaaactagaatcatgctggatagaaaatgaatttaaaaatttcaaaacaaaagaatcagacaaaataaatccataagcatgttggttcctccatgcaaaatcaggtaaggcttgtgaagggcttatacatgactagaaatgtgctaaagaaaagcagatatcacaattttcatgctccaaataaaattgtataattcaatgttctctgatatcaaaatgtaatatacaggtgagaatttagaacggaaaaattggtatatctcacctaccaattcttggcttagtacattatcagttatcactaggaattaccaagtttcttatatagcaacaactaaatgttctctcgggtaaaagagggagggataaataaactttaggctcaaaaatttaataaaaaaaatagaaaaagaaagcctgcaattagcacccttcaaaatcgttagcaccaaatatccccaccaaaaacatttactaattttcctttctcattctttggccacatttttatttacacttcagatcaggccagtgttcatacttcctgcatctgagcacaccatgtgtgcatatgaacattatcgcaccaagaaaattttttccagcctaaaaattagagttccaattgatttgtgtaggctgaggctgctgataagatcctgaagggggacctacagtttcaacgggcccagccacagcctgagactgttgcaaaagggttgaaggtgaagctattgtctgccctgcttgatagataccagcaaatgccccatgagcagcctgtgttggggggaaggtgagatgttgtccctgagggctaaggttatacagagaattaacttgccaactggacatgtcttggcctggagcaggtatccacactgcagagccttcactctagcaaaaaaaaaaaaaaaaaataatatgcttaggaactccagaaagtccaagaatttcatttcatgctgatgaagcaaacataaactcttaacaaaataagattgatactattgaaaaccagggaccaaaatatggaacaaaatttcctattttatcaataaatatgcatgggtgaaataaaggacattaaaaggaagtaaaccaaccagctgtcctgttgtatagatctggttttcctttaactgagacactaccagatcatcatttccagtggagcttccagtattaactgtttgacctggcgcatatcctacaggtggagtgataaatgatccagaaggaattcccatatgagctgtgtttcctgtgtttgctccagccttgaattgagggagagggaatttgatcccagcagctgctggtagatacatgctgccagcggatggttgttgagggaaaccattgtggtttaaaaattggtgtattggagacacataaattggagggtaatagtggccatatgggaagaaattagcagggtatggtggcctgaaaatagaaaccgactgtggagtcacaggtatagaattctgcaggggtggagttgggctaggggacacagcctgagaacttgcattctgcaatacaaagtaaaaataataaaaaaatagaatcatataaaaggaaaaaatatacagtcataataaataatatatgcacttgcaaagaattttacattgtcatccaattacaaaccgctatgtatggtaaatttattgacatttacaataactaccttaaaagtcatactaagaataatttactttttacagatgttaaacctttttaactttttaaaagtttatgaatggaaacctttttacttgaatgagtaaattaactttggaaaacaaatgttaaccttttactttttacaagttcatgaatggaaagaaatttaaaaaacaaagggccaatatcaaaacaccaaaccggaaaagagagcattcaaacacagggagattcggttttaataaatattaagcagaggaagatcttaggaagtaaaagatggagaaacttacaacaaagttaggaaggcgagatgtatcttgtgactgaggttcagttccctcaaattgaacttgctgagtgcctaacatggaggaaatgaaattcaaaccatagttttgagcagtttgaacagtcggaatttgttggccttcaggagccaacaaaacctcctttgactgatcaacctttgtgtcagtaccagttataggattgccatttgtagctggtgtcttttcaatcaaataagatgaagaatgtggataatcaagatgatctccttgtgcagtcaacgatgcactttgattgctatatccagacaagaaataccatcaaaacaaaaattacatgagcacaccatgacacaagtaataactttggtaacaaagaaaaatcaattaattcagccagaataattcataaaagaaataataactcagccttatgattgacaaagagcacggaaaatggcatagtattatctccaaagagaaccttcccactttcctagtactatctttctggcagattatagttgttttgttaagaagtttgatataagagaacaaagctaggaaattacaaccattaaaaagggcatgagggaacacacgttcacacacacacacacacagtcacagagagaggggtctgttatttgatatgcaaggcaaaagcacatatggagcagatgaattacaaaccttgaagttgcagcttcttcactcaattcaagggcaggagaagcattattgtcaccacctgttccactgttggacttttcacttgggcccaaagtatcaaagcttccaaacgtcagaccactttttaaagccttgggtacttggaaatggtttggaaaagtaacatgttgcctcaactctgctgaagattgcacacaagcttctgaagttgaaacctctgtggtattagctgtttcataaacatgtatgaacacgccaaaaggcattataagggatataattagagatatattgaaaagaattgagagaaaaattgtaagtaaataaataataggcaactctagattgtcaggatgattccttcaagcatggaagagtatcaaagcaagtaaatttgagggttagcacacaaaagcaaaacccatacaagtggcatgcttatttaaattatgggcttagtcatgctgcttctcacttaaaataccttcagaaatagtttctaaggttcttctcctgacctatgtcctcctattcctgtgggcttttcttcactatctcttctgaaaatttacattgtcctcctttctagtagggagagcaatgatagtatccatatggtagaattgtttgattggaaaattcaaggaatacttcaacccagtacattgagggaaataggacataaagcaaccctgttactcataagattaaacagatataaacaaaactttacctagaggtgattggctaccagaactggaagatggcctcaatgaatcatttggggatggagatgaaagttgtgagggttcagataaatgcttattttcaacttcatttaacttctgtggggcatttgttttgcttgttgaattcatggacccatatttttcattcttggatgccgataaatcattaacttcatgaacaactttacttcctttaacatgatttggtccggcagatattcggttgctcccaacttccctactaatagcagcactgacaccaagactccgggagacagatgatgctactacaggatccaaagaagaatgaacatcggatacagaagtttgaagttgatcagaacttgacacagactttccttggtcagtgctggtaactgagccaaaggtttgagtagaggaggaggatgctgcaacaacagctgcatgaggttggacattttcttgatggccagtgtccttagcagctgaagtacttttaggaacactaactatgggagattggccagcagaatcatggcctgacttcccattggattgatttgcagcaccatgttgagctgaaactctgcaatttaagaaaaatgattttgaagaggatacatatatctaactataaaaaagaataagtaatcaagccaatagtgacactggtgtatttctcatcacaccaacaaacaactttatataaatgtatttagcaatccaagtgtacaatcataagatataagatgttatcaagttgatcatgcaagccaaacttcaagcaagttgattatcaataaataatcaaaaattaagtatcctcttacttattctattcattgtaattattattagatattgaagttatgaaataaaaaaagagtacaatttgatgtttaatcaacataaaattttaagcatgacttgtgagatttggttagaattttaggcacaaaacaggaaaataagagtgatgtcatctttcacctttctttcacttcttttggagtcttgcttttcttttttattaaatacataaggaataaataagccatttctttccaccatacattttctcataatcaaaattaatctggtgaaataaacaaattaaagcaaatataaaacgaaattgctaccttgtagcttgagatattgtattagtcttagttttctgtgaaaatgtctgagtagagggagcatgacttctctctgcaatgtgattgactccattttcccttcgattagcttggttcctcccaccaccaccatctaacaacagacatcaagacagggtaacaacttacaagtcaataaactagtagaaaatttgatgatgcttaggacaggtctctgcactaaagcagttcatcttataaaaataatcaattaaaaaaaaaaaaaactaaaacaacatcaaaggattaatagtggcaacggaaaggtactttatcatgacatgctggattcaaaaggaatgtaatagggctcattaagcagcaaaataaaagcataattcttaatattcagataaaataactcagtaagaaggtgatgggaggaaaggatcacaaagtgataatatctttaaaaaaaatatggcattccaaaagtatttttctttcaagagacagggaaatgatggtttccaggtaaccatttgtggaaacgaaactccataaatggaagagacaagtaagttaataacaaagcccaaagtcaaacctctaaaaggtggggaaattgtaccaggaaagttagaagaatatcctccagaaccaccacttccccccctcccttgtccgccttgctttaacctaggctcatcagaagctctgctgctcaatccctgcaacaataaaaataacacaaaatactcaggctaataaaaaaatattaaggagaaaaagatgggacaatgcaagcacatttacttataactggacatatacaattacagaacacacagaaaaaaagtaaaaaacatatacaggcaattataaaacaagacccaagtcttttactctcagcaaataatatcacatgatcccacacttcatcataggcaggaagtagaaacctataacaacctcaactgttcaaacattcataaaaagaaaggattcttatagaatctcaacatggagtctgccaatcacagtgctcataagatgatacaatggcaactaatgacacaatgaaagcttgcctagcagctcacaacaatcaaaataataaatacacttcaatatagtggataaacaggtaaaagattcatccactacaattgatcccctcaatggcagaagaagcaccaaattaatccgattcagcaactcaactttcaagagcaagtaaggagggacgggagaatcttacccccttctttcggtcacgtctccttctcacctcatgaaaagtatctgtgaacaaaaaaaaaaaaacactcgacattaaaaagagagagagagagagagagaatctcaaatatgccataacacatttcttttcaagaaatcctaaatgattatatagtgttgaagccattagttaagaaacacgtgtgagcgagagagcctgagagataagataccatcaaacaccaacaatatcattagattattattatattcaactactatagctaattcctcgtcacataaacaaaaccctacaaaggtactagcttttatctccctgaagcgcactgatacacaatctccttgttgttcccaaacattgaacaaagtttcaatgtccaaagagccgcacacacagacgcagctcccctcacctcagcttcttacaataaatattttaaaaaataaaacatgaaaagatgaagtgaagtttgagcaacaaccctaacaaacagagacagtgaaagtgaagcttaaaaagtgggggaagtaggggagagggagagagagggagggagaagaaacggatcgcaaagaagataagagacctaaatagagaagcttctgagcggtctcattgggatccatggaacattcacggaggacggcgtagatttcgtcgtcggtgtgctgcttgccggtgatctcacggatgtcctggatgattttgcgtacattgtttgggatcggaaccctagaattcgaagacccaccaccgccgctcatctttctgtaacacaccaacgaagaaacaaagaacacactgtctctgttccccaaacttatatatttttactaatacaaccaaaacacaacacagtcactttgaatcattaatatactccatttccattactatgcctattttttattttaaatttaaataataactgcttcaaaatctcatctattctatatttgtttaggcttaaagaactgtaggtcctataaaatactttctccatcatattataattattttatcttttcaatataagattcattatttattcatttatatgatattaatgatatgagtcagaaaaatgaaaaataaattaatgatgataacattgattttataaaattaatatttttttattaatttttcttaattaaaaaaacaaaaacaataattataagaacatctttagtgttagatcttgaacaaagatcttaagcttaagatctgatcttcattagatctcccaaataaagaaagtggagagatctccaacatcaactgcacattgttcaaaaaaaaaattctctctcattttctctccctaaaatctcaaattaaaatttaccattatctcaattttagatctaccactaaaaatgacaaatagcataattcatcgtatcaatcaataaaagtgattaaatttgttgattttaattaataatattataaattttaattttattccaaaattactcataacataaacttataagtgattgttattttttaaaggataaatattcaaactaattaatataccttattttcttaatagtataataaatatattcactttcatgagaattgagtatatatcactgaatctcacaaaagattaaggataaaaaaaataacaatcaatacactttttagatcgacattaattaatgaaataatagtatgtttcttataattaaaaaaatgttattttttatttcttatataaaaaatatattaataataaataaagattaaagtcttcatatttaatttaagtgtcatatttaatataatttttaatcaattggctaaaaaattgtattaacagaatattaaaattagattcatatgtatatgaagagattaagttatacttataaaaatacattaattgttataccatttaataatttaaaattgtacaatcattttccaaaattcactaaaaattcatttcacattaatcatatttaggaaaaaaattattaatactaaattattgtataactcatttatgtacatcaatatttatttatatgtttaaaatatataaaatataaattatttgattatctttttattattgttcaatttgaataaaatttataaaaaaaaataaattttgagtctcgtatgaacttgaattattaaacataatttaaatataattcccttaattatacgataaagagtattatcattctccttaacgatgtatttgtatttttcttttgggatagttccgttgacctagtgacaacaatatctcaatcatcaggatggcttttgaggtcaggctaaccaacatggcttcttgaaacgccatgcaacaatactagaactaaaaaatcaacttgtcaaatatcagaattagagaaaaatatatgagaatcataaatttttacattattaaggtgtgaaagagaaaagttcttaaatcataaaaattatttttttatgaccaatttcttatgaaaaaatatatttgttcactttagattatagagattctatttagggaaagatcctaaactggatcatgatggtaattttggtgcgaagcatgatgacgagaatgagatcatacgagacattggatacttgtatagactcttattttaagttaatatggacttaagatggagtgttgtcttagttatcataccaatgtttgctaatttatataatgtttatggtcgaaaaatcaattatccaattgtcattacacacaggatgtgtgccctaaagaggagtgtcacacgttcaatatgaatatcttcttagtttagttgataaacttgtttctctaggaggggttatgatgtccttgaaagagattgatataggtaagaacgaacactcgattattatgatgagttatgcaaatatcacaattcgcatggtatcaaggtcccacttccatatcagttacccttaagtcggtggcttctttgtagaaactgttggcttttatgcatttaaagtgatataacccatttgtataaattggattcacacgttattattgagtataactcaagttcccataatattgagattcctctttcagaataatattaatcctgaatgaccaaaattttaatgaatttattcaatccttatttaagaaaatgaggggaataatttccaatacttttaataataatttctcttgtattcgattaaaacagtttcgtataataatattgaccaaaaaataattatgtttttgttattattgtgagacaaagaaaaaggacacatatgacgtataatataatattatcataaattaagcagggttattaactttaacgtaaaatttaaaatttagcctattaaataatttaaaaataataaacaaaattggcgaaaataattgttgagctatgaagtaattggactcaattgctaaagcccaaaaactactgactgtcaaactgtagttactgagtgacaagttagaattgtgggaattgacaaagtgcgaagtacacaacagttgatagtagctgattgtggctttttgacaaagaaggggtgaaaaaattaattatcatttggaagaattttttttataaatattatcgaatggaagtaaattgtataagatgttgcgacattaaatttttttataacagactttaaatttttttattataatcataaatatatttacaatttaagtcgtaaatatatttattatttctattttttattattattataagtcttaaatatatttacggtggagtttgatgtaaacgaattctgaatcagaaatttaagacttacccattcgataatatatttaaaagatgcccaaatgctaattatttttttttttaatcctttttgtcaaaaagcaactgattgcatctgcatctgtttgtgttcgacagaacagaatagaacaggaacctcaaacctttgtgtcgagaatcttagccatgggtagcaacggtttgaggtacgaaatcgcacaaaactcttacatcaaactcatccttcactcactcaaaaatccaacctgcgccgtcaacggcgtcttgatcggtcgcatctccgcttccaacgacgtcgtcgagatcgccgatgccgtacctctcttccactctcacatccctcttcttccccagttggagatatctctcatcatggttctccctctctctcttctctagggatttatcattttttttttccattcaattcttaccccatattgtaatttacaaaattatgcacaaagacgtatactttcttaatcaacatgcaacctaatcaactgggtttatctttttttcttctgggcatctattgattttttgtttgctttgtgttgcctgtagttttctgatttttttttaaatcaattttttgtgtgagatagatagaggaatatttttctgctaaagggttgaacatagtgggctattttcacgcgaatgagagatctgatgacagtgagcttggtggtgtggcgaagaatattggtgaccacatatgccgctactttccccaagccgccgttttattggtttgttgttgatttttttttttttttttttttgctaattttgtttttaattatctccttttgtttatcgtctttctgtttttattcaattattcgcagttagataacaagaagcttgatgctttgaaaaagagcaaggaccgtagtgccataatgcaggttagcaatttcagtactggataccgctttcatcaagatcaataatcattgtgtttatccactccatgaattgtatttgggcttctttagatgatacatttgatcaaaccatcaaatgtatagaatagaaaccattctgatctatatgaatatagaaatcctcaagggcttttgtcagtggactaaaataaccccttatttttaatgggatcatgaaaacctgtgaactcgttagaatatgtatattttctgcagtttgctgcttttgcattggacagttaggagtttgcttatgttggttggtctgactgtcttgtttttgtggcttattttggtgcatcattctctaaatttagacaaaactgctgtatctaaaaacttaactagaaatagggggctaggatttagatatgtgggtttcattggttgtaacttggatcatcttggatggctagaattcaaatttcaggcttaatgtcatgcttcaatttctcttgttttcatcatagctcataagtcagaagagaggaatattctgatagggactcagatattatgaggtacctaaatcccacctcaagtagtatgagatattcggtgaagtactcaagtggcttggttctctccccccgccaaccttttaacagctagcttttaaggcagggtttcccaagtgcttgggtgcttatcatattcctgtttgatttgccacatactgcagcatatttgggagccactcttttgggggagataatatttttgtcttttttccaaaagttctgtcaggaaagttagcaaacaaacaaacaaaaaaaaacttctctaaaataagctaaaccaaatatgtactaagatctatcctattccaagagtgggagaatgaaataataatgttgtctaacgtgcacactttgcatgattatacaggctacaacctcaaagctataaggcttcatccaaaattcgtactaattataaagattccttgtcttttgtttcttagtgttacaaatcttatggttctttcaaaaacactttttttttttgttataaaagaagaaattcattatctgcttgttatataagtatggttccaacttcctagagtttatgctatatataatatacggttcccccatatataaagtcatttttttgttagttacattaaccaagattgcctttttcttatggtttagctttatgttagggatacatctaagaactggaagttggttcagtcagatgggaacaatcgattctctctcaaagagccatcagcaaatctagtcttgttggactatattgcatccgagaagtggaatgacattgtagattttgatgaccatctcgatgacataagcaagtaagtgctttttgcttgcagtatttctttctttccatagtattttatttatctgtgcagctataactgactaagactttacataatacatattctattgttttcagggattggctaaacccagggctttttaactgatcccggcccttttgagtccatttttgcgctatttactttgcaagtggaggatattgaggcttattatggtgtatgctggattctcaatgatggacatttagggactatattttgaccctaggaaagttgcttcatgaaactttttcagttgtataagcaggatatttaccacccgttcgtaaaggattttgattgcagagcctctctctcttttattccccccttggatgtaggtatatttaagtggatttttttttactctttttttgtttgctttgtttgtgagttgtgacgaactttgttacttggtagaaacaacaaaaccatcactgccattatcttagttaatccaatggttttcttatgtttttatggttgcaacgcattctcttttcagatttatgtttttattcaaaagataaaataaaattgggctgtacatgacaaagggagtgggggacagttataaatgattacgcgggcccaaatcattgtctgaggtgattatgattaatcttctgaaaaaatgttccttttctgatcaatatgaagcgtacaagtttgagcaggattggtaagcgtgtgatatgcaagtagtagcactaggcaacaatgccaatgatggtgaggatgtttttatcaaatcggtttcccactatttcagatgtctgtggccaccgtgagtttgttgtgtttgaacatatttaattggatagaaatagaatacaacaatgatcgaagtcaaacaaatacttaatgcaaacaatttgcttgccctgctaacgtaaaacaatcagtacaagcttgttcaactttctgtttatacaatacaactcgcttaattttttttttgtcttgtacgagtatttaatttatattttataatttataagaataattattttatattatttgaattttaatatattattaactattaagtttaaattttataaatatatgttaatagatatgtcaatagataatttataagaagatatttttcttagtcaattttgttcctaaattgaacaagaaattatcagctaatattcttctcttctattgctcatgtacacaacctcaagtcctcaactgttttgcgctgatcatggcttaacattcagtacaaattcttctgccaacgactttcaagttttcaattctcaaataaaaaacccatcagtttctgaagactctcttataactgctactacgcacgataatacgtttcattctttgagtggaactgttctcttctctcactcacaccctcttcttcctttctttctgtaaaactcccttttccttaatttcttgctgatagtacaaaaaatgtttacaacaaaataccatatgatagcagacatctttgatcgaaacaacacaccataatagaactattatatgatcatgtatcatcctctattatatgcttggaagctatgttggtgatatgtcatgatagaggtgaggacttgaaaaaaactatgataaagagtacaacaaattttatgtttactaatttaagttttctatttttcttttttgttcgtatgcaatgttcattatttctctcttatttgttttccttctctctcttatttctatatatttaagatggccgtatttgactatctcaagttaaaacattatagtaactaatatatcttaacttgcaccaaaatacaccgtgttcctattatacattctattacttcaaattttattttctcatctaaattagttattttttaaaaataaaaaattgttatcgctttgtttataattcagtaatttttttaaaaataaaaaatgctatcttttgtttttaatttagttatttttgaaaaaaataaaacctgagcagtttttctttttctttttcttttttacaacaacccgagcacttcctataattatttgacttaaattaaaattcaaaacaaagaaaactcgacagtttaaaaaaaccccgaaaagagtgtaatgaagactgagaattttattttaaaaagttaatacaagagagtaatgagttgaaatttcaaaattaaaaaaattggcaatttttaaataacagtattttggaattttaaaaataaaataaaatagtcagttttcaaatattaatggtttattttatgaacaagaatagagtaacaagctaattttggaattttaaaattaaaaaataataattagttatgtcttcattcttaaaaatttagaaaacaaaactatttcattaatatcccatcgagcaattaaaaaatatgaaacaatttaacataaaatagatattaactaatattgttgtgaataaattttcaaaaaagaaatcaagaaatttatttattagattcaatttggttcctttatttttttaaatatatttaatttggccatttatttttaaaaaaattaattaagttttttatttttataaaactgatttaatttagtggtattttaaaaaaactgactgcatttgtttaaaatgtttgaagttaacaaaatgaaattagagcaaattaaattgatacataactagagttataattaaaccttttaaaaaaagattaaattataattacattagatgaatgaatggatgatggaggttagagaatacaggtcagagaagaggacatccatgagcaattacgcctggagctgtggggcatttggccaaaggacagtggtcatcagcatcttgaccccaccatattggaccaaaaacaccataattttgaagggcaaaatacagaatgacacccatgaaagcaacgccagcatctaaagcagctgagaggatgtaagtatatctagcccaccatgccttgaacttactgtaaacgtagaaattgaagaagattccaacaaatccccaagttatgtagttgacggatctggctggtgggatgccaccaccaccagcaatgattaagggcatattgatgagctcaatccacttgtggtttgggaatttgtgagcaagcagccacactggaacaggagcaagtaggccaatgaggaaaaaccaattcatcccagggtaaatcccatccttggtaaacattctctgtggtcccactactccccaaattattgaagcattgtaaaacacttcgtcaccagggcatgtccatggactaccagctggcaagtttgtttcatcacatatgtgtggaatacttgtcagaagccaccatgctgttccaaagtacacacctgaagcaactatggtacctaccaactgaacacaaaattaactatttatttgtttgtctgatcacttttgttaaggagaaaggaaacatgacaaagattgcgagttcaatgtctttggctaataaaagtaacattctaataaaactaacatttactgatttaaaaaaaaaaaaagttgtttagatcaaccatatatgcatgcatttacatcctatcatatcctatacctacctgcacaacgaacatagattttggaggaattttcatatagtggcctaatttgaagtcttgaaggaacccgagtgcttgtgacatgctgatgtacccataagtcttgaaggctacattagcaagtggccttcctgggtaaatgtacccaattattaactctgtaatcacgttgagtccgacttgctgcaaaacaagaaaaatacaaccttttgaaagccatacaaaacaaacaaggcattgttgcattttgcatgcaaaacacttttgtctacttggacaatattggacgttaccgtgtttgttgttgcctgaatgaccccaattggcaaagtgaaaactaacgcaattaccagagacattaggactccccaccatggcaattggagttgcttgccaaagccttcacaagttatcaaagatacaacgatcattagaagcaaaatgctaacaaaccaccattcaggtacttgttcatagtttctcttcataattctcgtgtgcacatctccaagttgttgtccttttagtgcagaagttgtcttcttccacatctgataaatcgttctttcaaatagatagccacaagcataaagttagatggtttattataaaaaaaaaaaaaatgggaatgtaaatttagatacactggtgaatgatattgttctgcaatcaaagttgaccaagttgtattttatcttaagaatcactgccaacctttgaattggagaatagtatcatgagtaccaatagataatacaattttataggtgttttagatattatttttcaatcagaattataatttcacctctacaattcatgttgacatttaatgaaatcttttattgcatggattatcgaggtgaaactctaaatccagttagaaaaacaacacaactatggaatatcatctaagttttatccatggtactatatttaaattatatcactaactaaacaaagcttactttccatggaagagggcaacatgggcaatagtagcagtcagagttgcaaagctcaatccatagtcgaatgcaaatgtgatactgagatagagcttgctgtaattgttataattgtccatatcaatgtcaaaagttttagcattcaaaacccgagtgacattatatgttgcgccagaggaatcaaatgtgtgagaactgatgatggggaacttcttggcatcatataggttgttccaataggaaatgggaaccagaacatacataaacagcacaaatccaaccagaatattgatgatggcaaagccaggaacagccaaaggactccccaagaagccagccaccgtgttccagtccaagccaaatgaaccaatgccaaggcctttcatgcccgaaccaatttgttgtgcagtgatggagtttttccaaaccaagcaaacaaaggagattgttgttattgcttggaaaaagtagcctggaataacgtaatatgcaaagcttgctacaaagaccaggaaaaagaattgcagccttgtgtttcctcctttaggccttttctccttttcatgaaatgccctgtcattatcacaggcagaatattccaaaattaaaagtttcatataattaatccttttcattcacatatccaaaaaaataaagacgccaaaaatcaccaaacaagaaagaatagttaaatttaaatacctaaatagagacacttgtacaaggtttgaaggccaccacatgtacggggaatctacaagacatttcctgaaaatcccagcccatccataaccaagcatctaaaaattcaacgacaaggtttagcagactaaccatattttgaaaaatgcttgttattttgattaatagccttaaaagtaaaaacaaaaacgagtttttatattcgtatatttcattttggaaaatgctctttagtgcgaaaaatatttcgtgaaaaagttaagaagagacttcaaataaatataatttaaaaaatcttttcacaacaaccccgccttgtatgattatgaatccctacttttcgtaatctaatttttaaggtgtttttcatactaaatagcattgttgtttcattttcacttttttttttctttcttctatttctctcaccatctcccgtcacatcatttatgagtttctcacttctctttttcacatcattgatgtttactatataataatgaaatggtaatgacctgggtggaaagtgctaagagaaaagcggcaagtggatggatgttcctgtggtagaaagccttaacaatagtgacaatgttgatggcataaacaccactagatccagcgctggcaaagatggtgatgagtgcatgttccttcagattgaaggggccagggttcaaggagaaagaccacttggtcaacggaacacgaattggtttggtgggaagtgttgctgccatgagtttcccaactgggagagagagaatctgtgctgagacggaggagatgtagagagggttggttctgtagccgaagaattggttcacaaaggagaggataatgcatgaggccaaccccagagtccatgttctgaatgtcagtgctggttgtgttgggtcgtcggttgttggaacggtgagcctcacttgctcaataggagactcatctacctcatcactttcatctgcaacaacaataccaacatataagattgattaaataactaattaagaaagaaaaaagaaaggaaaaagattccaaattcgatctttttttttgttaaaaaaattacgacaacaacacatacaatacaatacaatacaatacaaacttcaccgtatagctatgttgaagaagaaaaacacacgcgtacacactaaaaagcataaaaagggcaccggcatacacaaacaacaccacaaatacaaattcaacgtggctctacactcttgtctatgatcaagagagagaatatgttaataaatattcaccaacttcgataaaattacaagttttctggatgaacttgaaaaattctttattgcagatttaatttcatgaacaaactttaaaaaaaaaaaaaaaaaaaaaaaactctacattaaaccactccctttcacttggttggtgatccctcttcaacaacaacaataacacaaaaaaaccaacgagacagaattatttgttggtaccagacaatttcacgcaagcggcaaagaattatcatggacgataatgttttttgggaacatgtaatgcattttttattcaaggttcaataatttcataccaattaattcattctcatacgcccgatagtaaaaccaaataacatgttacagcatgataatcaaaataaactataatgaatgttaactcatgagtatataagacagacaagacaaggaaggaaatatgttagcaaaaatgaaggggtgttgtgttgggttatttggtgttgtaatagtaccaggtatgccaagttttgagtcgtgctgattgtcgacgaccccagccattgcaccgggatctggttcttgaaccctctctctctctttcctcgttcaggcacgcgaagacctcacgttgttggtatcattttatagggacgtgtgcactaccgagcatgccgttacagaaaacgtacatgtgtgcctggaccatttagtggtgttaatttattcatatttgacgtaagcatgatcaaatcaacaatgtatattactaaatatcacacgagataaataaggcggattttaatgttctatccttttattttagcaaatcttgtttatgactctaagagttgaccaccaaaattgattctatatgctctaaggagtaaatagaatttgactctgttctctgatctgtcttattttttttagcccttctcttatgaatgagttggcatagtagcagtttgaaataattattttctttgaaaaaatacacatgcatatttattttattagggactcatatgcacaattgatatttgatatattagtcttcaataagattaactagtacgtaattaatgaccgtgtgtattgttcagattattattgttaatttacaaaagactgttcttttcaatgaaaaatcaatttaaacctaattaatatatcaatataataaatatgtattgaaaatattctcctttcctttttattgtaattttaaatattttaaatgcggttgttttttttattcttaatgattttgttaattttgttaattttgtttgttttaagagaaaaatgtatttaataacccagaatctaaattaattattgtttgtcgtgtgggttaacgggcacaattatcaatcatgttttatactatatatatatatatatagagagagagagagagagagagagattgatgattgatatcatactagaaaatgagaatatttaactagatgtatggaaaatataaagaagggtttcataatttaatagtttttttttacataccaatactttttgatttcttattttttctccatacaaaaagcaatcttaatcttagtactaccatgcaggattcagaatttgatatctcaacagtttgtttaatttttaatgtctgtttaaagtacatctaatgaaaattaagcactacgtgcattttcataaaattaatccgaattcttttaaagatttgtaaaacggctgccaaacttgtagttttttaatattaactttcaaattttgaatgaaacttactaatctccgtaaatgtacagtgtacctgtccgaatgtaattttttaagtgaactatcagtaggccgagggggtacatatataaaatacataagcttaaattaagtttttatattaccaataaaatgagtatgtgtgagctgaatatcttatggagaaacagcagaaacaataaaatgaaaaatgacatacattacatgatgctacagtttgatttcattggtaatatgacgaagtcgatcccaaagctgagtcctctacccgctgaccttccttgccatctagctttctggaatttgtgattctctttgatgtttgttaagcgattccaaagctgttggacaagaaagaaagtggacttattcaacaatgtataatgaatggaattacaatctggtaatgaaagttagaaaagaagtacccacttggctgcattatcagatttccattcaacaccattggggtccatgccaatattaatggcagtgaactttaagatgatgcagggttcagagataagactgtctaaggaatttccattttagtgaggggagaagctatgtaccttctttcgctcgcgatgtgcataggtctctaactggttgaagtgcataggcctctaagtggttctcaaccgtcatggacaaaattacaaaaaaaaaagaagttaaaatatgtacgtgatttgttaataaatatgtgaattttaaatttattttttaataatgtttattttatttttattctttgataaaataaaacatttatttttaattttttacattttttagttcataatatattattaaattttgtgtttatttttttataatcttttttattatcggtttctctttggaaaaaaaactaataataaaaataaaaatatcaagaaataaatacaaatttactatttatcattaattaaaaaaatgtaagaaacataaataaaattattgttttatcatagacttaatgttaaaaaagtattaaaaataaatataaaatttaaatatttattagagattaaaaacttattttgaaaaaaaaaatcaataacttgaggtttttagacacctatataataaaacgaaaaaacaatgtataggtgtgtaaggatcaaattcttaatttaatcttaaatgtaaatttgacaatttaagagcgttgtttaatatttaaagtacatctaataatgattcttaataacattcataaatgatgctgacaaaaaagaatcatatatgatgagactttttttgtttttggtaaatataaattatgagacgtttttgtttatcacaataacgtattgcaaacagctggtcaaaataaatttcattttaggaattatacttttatttaatgaacaaaaacttcacgtgccaaaatgtggtataaattaaacctgcgaaaaatgtatagttgaaggaagttcacatagactttcttttacactcaacaagttcagaaaactgacatagcacgtgaatattaatacacgtgattattgatacattatcaaatgtaacgtctccagtctactaatgagaaatcgttcaatgtacgttacacccacatggattagttaggtcattacactaaaatataaatataatcatttgcccattaaattaactcaactgtctcgacgataatttttaggttaaattaattttttttactttaatctttagaacatgctatttgttggtaaggttttaaaacactcaagtttcaggtataactttagtgctttttgacttgagtccaagaacattatatgtcttgacaacaatggtcataactatctttagaacatgctatttgttggtaaggttttaaaacactcaagttgctctactgatcttcgaaccatgatggtcttccgaaatctccaaggtctcttttcagcatcttttttggtagaggtttgcgaggttttttacttattgtttctgtacaacaaattgatgagaagcttatactcttaaagaattaagatcacattaagacatgtttattttaccatttgtattcttattttcagcttgaaaatattcatgaagatgttgactgtggaagtggctggaatatgatttttgtatggtgataggtggttcggggggagctggtaaaaaataatgataagagaaaagacttatttttacagtgtgaaacttctttttttggatggcaggggtgtgaagatcttttgtgagggtggcatttaggcgaatatgtggcaggtcgtgtgtggtgtggctgttggttgagagcagtatgttatttcttctatactgcattaaatataatcagatctcaaaatgcattgtatatttctttttggtctgtcacagctgggaatttttatgtcttaattgagaccttttcttttattcaggtttttgattatttatgctcaagctagtgttatgaaaatcggaccagattaatttatgggatcgttcatgcatgtagctcgatttgagtcaatagtaggattgttcatgcatgtaacctgatttcacacgccttgaactgtcgattttgtaaaaaattggtgacccgatcaggtattacgacctagaaaggattaagtgtagttttttttttttttggaatcgtaaaatgttatctgaatatgacttgcgatcttgtatgtatttgagttgtgttatctaaatcgattttgaaaatcctccccatgttgttgcaagaccgtttctcttcaatctttcacccttttatttgcaaaaatgagatgtcgaagccgctatgaaaccgccaatttgtgttgtcgacgagaatatctttgttgttgcgtagccttattttactctacatttgcactttgatttctctagtgggtaacaatgctaagttactgtgtaatactgtaataggatagagtctagggtgccacacccaaactccttgtgcacagtgccaaagccttttcaaattcccatttcttctacttttccaaatttatccctcttcttcttttcccatcttcttcaaatctagagtgccccctttcatatgatctccatctctccacacaaattagtgccacaaccaacattgtaactatggaagaaggacgaagaaggatcttgacgacttgctcgtgaccccctatctctacgttttaagttttaagaggcattgtggaagggataagatgttgagaaaaagggagcatatgatggaaaagaccgtcgatgacgtcatttgcgatggaaggaactattctttccctggacgatgacgaggtaatcgtcgtctcaccattgatgatggttttctgattacaaagataataggtttcagatctccacatgctttcgcatcatccttgaacaagactttcgtatctacaattattttgtgtatttttgtattgatttcctagatcttaacaatgtacacattattgtatagatttgtgactgaagatctgaattaaattgcacatatgcatgcaaaaaattgcacggacgcacacaatattgcacacaggcaaattgcaaacacgcacacaagaaaacactaggaagtgagttgtattgttagggagttttatgatgtatgggaagattaattgggttagtttttctgccctttattatttcttctcggagagcctcatttccctaacatatgttcaaccctcgaccaaacactcttgagatgaatgagtcatcccacatggttccaccattttcataggttatggttgtaagaccccaaccaaacccaacttaccctaagaagatgagaaagacaatttggataacatataacaaggcaaaaatgacctttttggcaatttatcccttatatctagcatcgacataaggcttccttccttaagcatgctcttgtgaaaaaacatatgcttggagacgaaaatggggctctccagtatcttatggtcgtagcctatgaaaacgacgggggccctgtgggaaaactcatttttctcagatgtgtttggtcaagcccttaaggtaggcttaggaaatggggctctccggtaagttggatttggtcggggtcttatgatcgtagcctatgaaaacggcaggaccctgtgggatgacttgttcatctctagagtgtttggttgggggcttaacgtaggctagggaaatgggattctcatgtaagttgggtttggtccgggtcaaatcgaaatatgtcattgggtatttgaaaatgacattatctagaccaatgctaattgacttcaattgctaatggaaatgtaagtaggctcataattttagaagaagccatatgttcatgtaataatcacacactaatgagcctgtgtttgtgagtgtgcattatgttagtcgtctcatgtactatgacctgtttaatataactatatattaaaaaaattatgactcatcaacctttattaaaatgtgtcttcttgtgcaaatctttcatattaatatttttaacttgtgttaattgtgatataaagtatgactcgttattttatatatgtaaatgtatagcttacattgattctggtgcagataaaagtaagggtgttcatggctcggtttggttcgatttttaataaaaagtcatccaaaccaaacttaaaaaacacgtgattcgattggtttgattttcattaagatttatatattttcttttcaacttttaaattaaattacattaaaaattgctaataacaatctacgaaacttattaatatgttaaaccttctataataaaaatttatcaaattttcatcaattttaaaccaaacatattttaaaaaaagacgtctaaaaaaattgatatacattgtataaattcgtatacataacactacataacattgtgaaactcaaataacatatacataaaatagataacattaaagtaatataaattttatgatttggttcaattcgaatccgtttcaaaagcacaaagttcaaattgaaccaaactgtttagtttgcgaaagaaaaaacatccaaataaatttaaaaagaatcaatttctttaggtttttcggttttttatttttagtggtttttgattttttactttggaatagtttggatttgaacactcttgaataaaacacactctgaaatccagataggtgatagaatgagcagtttttctgtttcaagtgcatatgaaaggataataattttcaatattcatatagtggaggcttttggaggaaaacatggaagcttaaataccaacatatatatatatggtagcttcaaactagtgagagggtccgagtgtttattggcaaacagctcatgctagattgcctactaagaaggggatcgggttctcctttttgttttcattgtcattccttagaagaatatattttgcatgttctttgtgattgtccttcagcctttactgtttggattcatcttctggaacctgaattcataaatgtttttgatgtgtgataaattctctgtaatagaggacagagaaacctccaaagaagaataacaagagagaggaatcagacaatattcagcatttctatagctaggccaatttccttattctaatagagttgtccctctaacagaatgaccccattcactaacaaactcacataaccctcctccagaatgttctactctgtctatatcagtaatagatatattcagtctcacacagtttggcttaatactcctcttgggcctatgctggacttcctcatttttgcatttggggcacaacatcattgatcatatcagttttctttacaattggattaatcttaatcttgataattttatgggaagcaagaaagataaatgttggtctactttatgggcggttgcttgtcacaggttgtggacttggagaaataaacatgtccatgaccatgacccttcatttgtttgaccttataaacctttgggagattattacaacggcttggaaggagtaccatgcaatagtttatatcagttgcctcctgttcagcccaagagttatacaaatatcagatggattgctccatctcttggtaggagggttactctaaatacctcggtgaatgggatcaggaatgacagtggaaagtgctttggaggatttgctaggaagattggagttaattaatatcaagaatattgcggaggtcttagttattcagttttaaagtttgttaattactatcaggatccagctttcaagttcaatcttctgaaagtaatatatttgttttaaacataactacacctttggatgcgcaggtctttatatgaaaaaatattacagtacattttagtccttatagtatgaaaaccgtttataaattgatctttattatttgtgcaggttattgtgacatttgactttgtcattagacatggtgatgtatggtaagatattttagttgatttttaatttttttattaattaaaaaatttgtttgattgttagataaatatttttgtaataatttttaattttttaaaatagtattttactttttagtttctaatttttaatatatttattcaatttcatattttaaataaattataattttattattttttatcattttatatttttcaattactaatagttagttttatcatacacttgtaatttaataaactaattttaaaattttcaattgtttttaccaaatataaccatcattttttgtttttgatacttacatcatctttagctttggtctttaatggaaattttatattttttgttttgatctttatatagaaaaaaaataaatatatttttcgtcattacaattttttattttaattattgcaaaatatgttttttgatttttcatctttaaaatactttaaataacatattttttattgtttaaaatattttttactgtttaaaataaatatattttataaatattaaaatgaaagaaactataggaacaaaacgaaaaaatagatgaaaaatatatttaattaagaaaaaaatctagattttggtgtctacacttgacatatcgtcctttgttttaatttcctatattaacatttttgtggcaccgttataattttaataaactgtagatactcataatttataaacatattatgtagatactaaaatataaaatctttttatgtcggaaataaaacaacaataaaaaatgtcatatacgatgaataagtttatgatataacctagacttaagttttttttttagactagaggccctgaaaagactgtgagccacaaaatttgcttatctcccaaataagtaacaaagcaaataacatagtttagccacaaatctaatcgaagtatctgttgttcctgtagccaagtaacaacctccaatcatccctaacacacattctcgtacccgttattagacataaaagcaggatctgaatacgtgggtatccgtctgaatccaccccaattttaatagaaaaagttcgagtttatcagatttaggttcggatttttcccgataaccaaaaacagggacaggaacggatatgagattacttatacttgcctcacacccgcacctgccctgtaataaataatattaaaaaaatatatattattttgtaattttttttattgaattgattaattttgttatgtaacttttaaattatgactgcatattttgaatatgggtttgttattgtttttttgttacgtaattaacatttttgtccgattttcaataattttttattttattttaatcaaagagcgaggagggcggggaaaacctaaccccaatggggcggggatgagtatgggttttaaaacccgatggagatcggagacgggttcgaggagcgatttttgagtcggggacggggacgggaaatgcaatattcacccccgctccgcctcattgccatgcctaccccctatacctagattttagttttgacgaccactttttttatttattggtaattctaaccggcaaatttcatatatttattttggaagtcaattaacggaaatatagaactcaaaacaaattacttaagttgtacttttggagatgttctaagataacatcatatttttaataaattttttatttatttaaatgttaagtaatataaaataaaaaatttaaatatgaaccacttcaccaaattttctatatatttgtgttttatttaatggaaactctattatctatataaaccagaagaattaaattagaaccgatttacaagttttctttattttatatttaccaacgaagcctcagtttttcattatttaccagatgctgatgatctgttgactttagttaatcactatgcatatcgtgtggaagattaactccatttgtattttttttttttttaaaaaaaactcctttcgtacaaaaaaatatttaataaaattccatcctcatgattgcgatataattaattttacacaaaaataaataataaaattatttcacgtatttattttttatatatattaaatatctcttattcaaattttggttaggagtaaaaaaaaaaatagaaagaaatgcttgggaagcaaaaagaaaaagaaagacgtgaaggattaaaagttaaaaggttggggagaaggacatgacattgttgtagtgatgatggaagtgatgatatgtgagcatttgcggtattcagcactctccatcttatctatttcttcacctcgttaccatcgctctataccttcttcttcttcttcgagccttaaaccttcttcttccttttctgtgtcttgctctctcatggagaatcaggagacccacaacaaccaaggccgcagcaaattcatggactttccgttcgtttcatctgcccagaagaatcttatggttgatctcgtctcaacgcttgagaatcgctttcacactcagcttcttccttgcacactcccctctgatgttcagtattatcaaagccaaactgccactgcccaagcttctcttcatattagagcagctcataatgactccccggtaattccccctcttctttctactcccaaaatccttagtgcttgtttggattagccttaacaaaattatttttaaatgaaattgattttgtagtgatgtgatttatgtttggatgttttcattatggaatcaaattatgaataaaacttaatataaagtttttgctccaacgcaaaagcaaagttgccaattctggatcagaatcaattttgaaatcttcagatgtgaaatcaaatatgtaaaaattgatccaaaatcaattatgtaccaagaatcaattcttgtgaaaccaaacacacatttaatttcaatactaagttttcatttttttctctcttttttttttcagcccctacattgttcatgttcccttgccaattatttatcttcccaaattcgttttgacttattttttagtggcttatgggtttctaaatcaagtattggcattatcagagtattgggttgagaattaggtactcaagctactatgtccggattagatactgaagcaaatgggcaatgtataacttttgtctttttctgtgcttcaatgagtaagccatcaaatttatccctaaatttatagtatttatataaatgatccctcaatgattagaaatcatatttagtagtccttcaaatattgaaatcctttaaattgatgaatatccaatactctaagaactatttaggagagagggtaatacttgagagttgagagactaaattggtggtttactcttgctttaatttgaatagcaatggcaaagtgtaaacataaccactcggtcagcctagcaatgaggggtttgagtagtttgcaagagttcctaagatcaaatctcattactgtcattgtacataaaaaaaaaaaaaaaaaagaagaaggaaaagaataaacatacactcgaattttggggtggatatgtgtaaggagaaaaggtccaacacgaacagaaaaaagaaaaggaagagaaagtgatatacgtgattagggatgtgaatgcttggttccgttctcttgccaggtagctactgctgacatttttctccacccttttaatggatttattttgtttagaagaaaaatgatgacatttgttttgttctgaatttggtctttttttggtgtttgtctcagatagattttgtgttgggaagctgggtgcattcaaagctaccaacaggagggtccttagatataacaagtctttcagcctatcttaacagctcaactgatgcgccaaattttgtgtttgaaatgatccgcagtagtccaacaatgctagttctcattcttgatttgcctccccggaaagaccttgtgctttggccagatgacctcaaaactttctatgaggacactcaactagacaaacataggcagactctggagagagttccagaggttcaaccatacttctcttcttccctttacatccgcactgtttcctctcctacagccataatggttcgcgttctgacggaaaatggcggagtggaacgcatggaggatatcatcagggaccatttggaccccatttccaagcaagtgttggggatctggttggatcattgtgcttgtgccaagcgagaggtgggagaggcagaaagagcttatctgaaaaaaagggatggtctcattagaaacaagaccattgagattgatcttggttcaagctttcccagattgtttggtccagaagtagcaaaccgggtactggaagctatcaaggagtactttactgtctgaaatgcaaatttatttggaattgttggatattctatgtattacatccatgtacctaatttgctgtgtaatccaatgaggcctccgtattttctgaatctctctaatcaagtataaaatccgtaaatgattatgatggtttctactttctcccccattattgtctgtgtatcagtaatcagttctctgcttatatatatatatatatatatatatatatatatatatatactaggtatgattcatatgacagtagcacttatctaattgcatctggttcggtttcaaactctttgaaggagtagagttgccaaacgccacgattaacttcctgaacaagtaggaaaattcttgaattggaagttttttagcatgcttgagagttgagagaagctggtgaaatctgaagtctggacctaaaataggtcaagtgccattcgacatgatttctataaaagaaatgttatatggctcgcttatgatctactttttacgtagctagtgccatttttttaaccaatatttggacacatagtgccatcatatttttaacattgcttacttgcgtttaaattcgttgaaaatgtataaaagttaaattttcattaattcacctcgcttatcataaaaaagaaaggtacatctggcaactcataataaaaattatttggttcgttaattctagaaatgttatgcactccctattaaaaaacttttagctcaaacacagtaaattctggcatcatagttttgacattgagaaacagtaagaaagaagggtcatcaatatttgattcacgatcagcatcagatactgtaaagcacatatataagttgcatggcgaatatcatatactatatgtacgacttatattttcagcgtataataggattcctcacatgttaattagctcaaagctaatcagtatacctactccacaatctttttcaccatatataaagattaaaagccttttaatgattcttggtgatatattttcttttgatattggattcttagtgatattatacctaagaaacccaaatctcaaattaataacgtaaacacgaagcgaaatatgataatggttgctcttggagaaaagagtttccattagaaaggcccaaaatgaacttcatggcagcaatacgtgcatggaaacagaaggcacgaaaaagctcttggagagttgccatatatacggttctagttcctatgaatgagagaaagaaaagtaatgcttattcaaatgtcctctcaaatgcaaacacccaaggacttgtggttgaatttgattggtcaagagtgacatatagttagcaccaagcaatttttgtaactgacacgaaccttttgtttatgataattaagagtttgaaaccattggcaaataagtaataactttgccatgtggttagaggtttttaacataatttcttgtgtattgaaaaacaatgaattaaccctttaaatgatattggtatttcaagacattgttactattcatgaatcttcgaatcatattttctagaaacgagtaaaatctatttgattgattgattataaaaacatttacataaatttcttaaaacttgaaggattacgtgatatttttatagttattttaattatttaccatttaataagaataatataatatttttattataataaaagaaaatctaagctcgggaaaataagattctcacctccatgagaaagtttttgtgaaaaataatttcctgaaatcttattttcttaaaacaaataccaagcacaagaaactaaggtagtgcttaatttgagtgtttttttgttttcatttttaaagaaaacaaaaaataagagtaaatgcatttgtttaaaacaaaaaatattttaaaaaataagcccacaactgacaataacttatcaacatttttaatttttttatgaagaaatgaaaacaaaaaataaatccttaaccaaaataccacctaagatttgcaatctaagattcttagaaaacttaaaacttttttcctaccaaatgaatctttagttaaaaaggagtttgaaatcatttttttctggctaataatttaggtgaattgaataccaggattcatagagtcatacaggtttcaaacataaaaaaatatttacaaaaatatttatatattatttatcaatagaaccctcacatcaacaacaaaaattaaatttatattcttttaaaatataaattcgtttgttatcgattggacgaatctttattggtagtttgaaaccatttttacttatactagagtaaattttgcttatgataattagaagtgtgataaaagaatgagacggggcatgaagatttttaaacatgagaaaataaaataatataattgaaagtgacatctcaacaaatgtagaaaacatttgacgtgacaatgttacatatgaataaataaataaataataggttgaaatagtatgaggtaataagcacaaacaattggaggtacaattttttccctgaactttattgtgaattccatataattgttacatgaacttttttctttcttatgtaaatttcatataagacattacgtttgcggattttttaacttatccatttttattcaaggtgagacttatgcatgcgtgtgactgtgtgaataacactgaggcagtacatattctgatattcttctttcggcagccacaccatatcatttcgttattcggtatatattaaagtgaagtgaatctctctttttaaacaagtgaacttgataatgctgaactatcaaggcatcgatccttaacatggaaaaaacttgtcaatttggcatcatctatcactgtcttaattacatctgcagagtttttcttttctctcttactttcgttttgcattattagtgagcatctctattcttaaccaccgaaaacttcaagcaaaaggaaaaaggttatcgtatatatatatctaatgaaaattaagcactacttgcgttttcataaaataaatccacattcttttccatcttttaaagattcggaaaacaactaccaaactttcaaattttaaatgaaacttcctaatctccgtatatgtaccatatataagcttaaattaagtttttatattattccgttgcacatatattaagctattacctatacaaatagaaacgtccccaaagtccaaacaatcatttattttcctttcctttccgtgtttgtatttatttaacagtttcttaattattatttttttataatgacgatcactcagttcagttcagaattcatagggaagttgcatctaagtccaagaaacttgcatgcttcgtgaagtggacaaaacaaagccagattttatacctttttgtatttcacatgctattgttcattttaaatttttgtggacagtagcttcataaaggagtttgaaagatcattatttcaaaccctagtcacaggttgtcctcaaaacttctcatccagttagtttcagagtttcaatctagtgtcaccacagagataaacagcaacatgtgtattactaatcaggaagctatcaagcagttgcagtcccttatggaaaactgtaagcatttagcatacacttttctgctaatagtgttttgttagtgaccaatatcttctattctttccatgttttttttaatatgtttttctctcgatgtagtggatgagcaacagaagaacacattccaggtttggctcttcagtctcttggttttacttgatcttaagttttgagaaagataatgacaaaaagaatcagtggaagttataacttgatgaatgtatctgttcatcttggataaaataagtcgccacaatttatatttatattttaaaaatttcagttggggtgggagttttgaaccaaaaaattaaaattttgcttctaaattgatcttgatgaccagtacctcgccgttggctagaattctttactgaagcacagctgcgaacattatgataatagatgttgatcatcatgagtgtttcctttattctgtcatgaaagcttgctctttacatttcagattatgcaccggggcaatccaacagaaacattagtacggtttctcaaagcaagggatgggaatgttgtcaaagcacataaaatggttagattgtgtgcagtaaaagttttttgttggaaattttcccaaattgattgcttatagagttatcattggatatgaacactttgctgacggttttaactataacagttaattgattgtttacaatggagagtggaaaatgagattgataatgttttatcggtgagttcctttactgtgcatattattgattttggaacaacatatcttaaagcagttaagcattatgtgacagatggagatacggatgcatgttttctttctttttatattttggggggagggggatgaattcacagtatcatgtcagtgtgtcaaggaccaaactttagagataccgagataaagatgcatgttattgcaaaaagtataaaataaacctagttatcactatcactggagaatgaaatttacatggtctctgtagttatttgatcatatcacacttctagcataaactagatgtctatcatatttctcaatcattgtgaattcatgatcataaaagtctatcattgtttaaattttccttcttttttgtgttaacagaagcctataccccctgatttgtacagacgtttgcgagattctcaacttgtaggaatgtctggtttctcaaaggaggtataagttttcatctcaggcataaatttattttattttcctcctacccagctaccctcatggttcttctctgcctctaacctgtatgaatgaatgatgtgtaagagatgacatctttgtgtacgactgtataaacatagcagatgatcaacaagatgtcatctcttacataaagtaacatgcatgattgctaatttattttatttttggctgagttatgccagggcctacctgtcattgctgttggtgttgggctcagcacatttgatgaagtgtttgtaaggactacataccatctctaagccatattatccttatacattggtgctgcagtgttcagtgctgcttatctgtccattttcctttgtagcatgtgaactactttattatttttcatgatgttaaattgccagttatttttgttcaggacaaatattatgtacagtcgcacatccaaatgaacgaatatcgggatcgagtgatgttggtgagtatctagagtgtctttttttgtccctcataaattctctgacaccctgattgtttattggaatttttattgcagccaaaagctacaaagaatcatggacgatacattggcacttgtgtgaaagtcttggatatgactggtttaaaactctcggcactgagccaattgaaggtatgccagtaacttaaaaacttcttatttctctttctcttcatgtttttaatcatatgaccgttccttgattggccatttattgaagtttttctcttctcactctatctatccactagatgatctcctagttgacactttctgtttggccaccttcagcttttgacagctatatctacaatagacgacttgaactatccagaaaagacagacgcatattacatcgttaatgttccatatgtattctcagcgtgttggaaggtttgtgccagtttttatgttgaaggagttcatacggatctatcaaaatcttgacaattacagctaaactcttcaatgacaatggcaggttgtaaagcctcttttgcaagaaagaacaaggaggaaagttcacgtactgaaaggttgtggcatggaggaattactgaaggtaaacattagcatacccctcgtacagtatatcttttatgagttttccttttagttctcttgactaaattaaagtcatattgtccattgttcttgttaataattaacctgtgatatggatggagacttgaaaaagagtactaccgaattgaatttacttcattcttactagaatttgttgcaactgcgagggtttgacatacttaacaatttgaacaggtaatggactatgcatccctccctcatttttgcagaaagaaggattcgagggtgccccgacatcatgtagctggaaatagtgaaaattgtttctcctttgatcatgtcttccataaacaactctataattacatcacgcagcaagctatattcatagagtccttattaccaatcggacaggattcgttccatgtagacttgccagagccagacccagatgatgccaaaattgccaagactatagaaactgagttccacaaaattattattatagattaaataacaaaatgaaatatgactcaaaaaaacttggaggattggattatgtctgcagtgacctgcagttactttcaaactgcaggcaattctggtcctatcgagttacttgttctttgcagttgttatattcagttattggatgtaatgtaatatacgggtattacatcaagttgccacaaacttctgggtgaataacttttaatctaatttttataacccctggacgatgagcaagtaaattcgttcagtcttggaagaatgacatcaagttacagttttttctttccccgtcaattaatggtatggtatttatacaaaaatgtagaactacagtgttcagaaccgtgcctgccagacagtattatgcatggaactaagaatagaacagttggagaaaatatattttcctcatgttgtgacttatgagcactattatcctgcaacaaaaattttcctttttatatcaaatatatcaagcctaggataaaaaaaaggccatgccgttataaactacactacaacttattttctcaattatattcatgattcctccttttcttgacaaaacttagggctagcattaacctgaatatctttgcatacggtggtattttctattcattttggaaaattattcatcaatcaggtgctagatgatttcattttctgttcccaatatgggtaagagactctctgaaggtgctgcattcttttatatgaaagttcaggcaagactatcgtcatttgtcacctatgcgccacacaattctaggattaactagcaagttcgaggaacacaaaaagctttacattaaattgtaaaaggttacaaatcaaatcctacctaaacaaagtgttaaaatattaaatttgattactctgtggctttacattaaattgtaaaaggttacaaatcaaatcctacctaaacaaagtgttaaaatattaaatttgattactctgtggctaaggtttcttatatgtacaaaaataagctaactggcatattataagtgcctcagccaataatactctacaagcactaaagcgcacacatcctcactcgtttcccagcatgttcagtaaggactgatctaaagaagaactgcactaatattggacatgaagctaatatccagatatagtaaaggcttaaggcttgttttatcttggtgacttgttggtcatgggttcgaatctgaaaacagtctctttgcatatgcaaggataagactgcgtacaatatctctcccccttacctgcgcatagcgtagagcctccaggtaatggagtacgtagttttttttttttttttttttttatagtaaaggcttaagttatctaaaccacttaataatgctgccaaagttgatttctcttatctcaattgtttgtaagagttataggcaatggcaactgatacagcagcacagaaaacagcaagagctgcataagtatcttcttgctcccagccattgagccaagttgccatggacggaaacttgcacgaagctcctttgccattattgatcctattgatccaagaaatcactgtctcactgctcttattatcagctgagagctttgcctctgattcaatgacatcagggtccattcttctttccaataacacgtgattctgacggaaaaaagagtctccattagattggcagcagccaactccatttgattggcagcagctaactccatttgattggcagcagcttacagaattgtcttgagctctacacccttgagtgctgtcttctaagtttctcaagtcattcagcagaagccgctgttcttgctttttcttctgttcatctactgataaacccatctgacccctgaaggcaatataaaaaaagtaacatatacaagtaagcatatgttccatggacctactatgctccaaagttttcataaccatcagcctgatacataaccatggaaaggatttcagcatgtcaatttccgaagagggaatctgtcacccaatgcatcaaattttttccatcgcaaaaaagggggcagaaagaaatgtacttgaaaagtaatggttgaagctaggtttctgaaaatttagagaaagagtagggaataacattacaataggagttaattgtatgtggctaagtccatggtttggaatttataattttaatttgtgaataaaaagcttaaacagtcaacaaccaaactggtaggtcacagatgccatttaaaggcatatgaagcaaagctgtatatcttcagataaagggtatgaagatgccacttcttgcctgaccacaatttcaatttgaaaatttacagaagcctagctatatagtcttttataggatgaaacttaaagatgtaacctttaagccaaaacattaaagaagataaataaagcattacaggaaataattacctccataatggatctaaaatctccccctttatgatatggtgttgaagcaatgaaggtacatcatccggggtaacatagccatacctgcatattttaattgaggagaatatcaatcagttacataatcaaacatattaaccaatggtacaatggtattgcatgatttaaaacaataaataaaaatttctgtaactgaaagtagcagttttagtaaccattaaggtgttctccttaccagtggccagtgacttctccattcatgctaggtccaaatacaatgacatttccagcatactgacttgctccaatgtgtgaacatgggcttacaaagacttttccttgaagaccatgcaactctatctcctccctgaatctactgaccaagacaggtccacaaaccccacatctgcgatcacgggatccatgcgaacacacgaaaacatacgaacctctcaacacctcaggcgttccgggaagccattccccatccttcacaagaacctcctcaacaaacgtttcaacatcaaaatgcgttaatctcctgcaattccactaaaacctgttgtccacaatgatctaagaagcggaaaaaaagggaatcaataacagagaacctttaagatcaatactctcacctgtatctaaccatgtcaggaaagatcaacacatccccattagatgtctcagtcccatcatgaccctcacatatcgttaaccgaatctagtaaagagagaactcataagtccaacacaatgtaagatgaagcaacattttcaccagatattcaattaactaactctttaacacatacctcgaacagtgatatagccaaaacagcgtatataagtggacataacgcttgctaatatcaattaccttaaacagcgtacacacaaacaaaatccaaaagcaaggggcggtagagtatagtatagtacctccttttccatgtgactcttccttgcgacaacggcggcatggagcaacctcggcaagcgatcgaactcggcggcttctatgcgcggtggccagacgcgagggttcttgtagcaaaggaagacgtggcgtcggtagaactcgacggtgccggcaagggggctctgccggaaatcgggtcgggagaaaccgaagtcgggatcgtcggcggcgacgtctccggcagagagaaggccgtcgttctggaagcttccggaggcgcttctggggtcggcgaggtaactgtcgagttggtcggagacggtgatgggagaagaatgggaagaggaagaagggattgtgaatgtcagcgattcttctctctctctgttactcgccatagtagcagaacacaaccaatctctctctctctctctctctctctctctctaacaaagtaacaactttgtgtgagtgagtctgtctgtgctgtgcttctaattcaatagttcctatttcgaggggtttgatgatgttggaggaggttgcgttcctgtgaggttgcgactaggatttttcggtggaatcgggtcgtgcatcaattatgtaacacgtgtcattcatggcttctttgttttcttgatggtgccaactcacgacgatccaatctaatgcccaaaccttcggcattcctggatctactgatttcggggattctgtagagttgtctacaaattattaactgcaaccttcatgcaaagaaaagaaagaaatacaaaaattgttataagagaaagaatttataataacaggatttacaaaaatgtttattataatggattttttttaatttttggtttattagcttatgtatttgatagatagcataaaaaatttgattttttcttaagaagtattgttgtatttataattatttgaaaacaaatgttatataatttttttattctcagtataatattttttttaaaaaaattgttttatccctaactgcaattttttttttggtttaaagaattattattagattatctttcttgcgattcagtgcttttactggaggcctaatgttcttacatgttcatcttattacctaaatacaaatgtgcccatctaatagatgatattattatttattgtttggcgtgacttcgggtgagtaaataaatgggttccacctgaacccgaacccgacataatcaaacttaaaaaaatgaatttgggtggatttagacggttcatagataagcgggttttaaattcgatcccaaatgatttttgacaatcgaatttaggttcacaatttttaatatatcgatatccgacttgactcaatattaaaagtttaatttcaattttttaaccttttagctatttaatttcaattaaagagcccaatacaaaattcacattaaataacaaaaaaaaaatgataaaatatgacttgacaatatggcccaatacaaatgaataaattaagtaaaaatttgaaagaaaataaattaagtccaaagtgtcttgacccaatattggtccaacccgtttggactcaaccgtaacccgtccaacctgaaggcaaaaaacagtcagaattggacctttttgtaatttatcagatggacccgaattactggacatttgatcggtacatgacaccaatgtgttcagtcttccaaacatgcaaagaatttataatctaaatcattttcaataatcttattttaattttccttagtctttgccctattattacaaataaattatttttcacttgatattatgagggtttcgttggtcctcttcttttgtcaaattatcttattatctaatctaatgaaaaatatatattctatggtgctttaatgtaaatttgttacctgttttctaggaaaaacagcttgaagcaacatctcatttttgcctcagtaatacagtttgccaaaaagagaaatcctaaccatgcctttttattagcatttcataaagcatcaaataagcaatgtaaaaagagtaataacaattgttttattagcatttcataaagagcatcaaataattgagaagaatggacagataaaggtatggtttttttaatagttattatcatcattacagtgaatgccgtaaaatagttcatcatactacctcatgaagtagcaatatacaataatatactaaagtttcattaataaaatacttgtgaccaaactattgacaaaaatctgatcgcattggtctcaactttcacaaaaaccagtgtgtatctctcacattcatgagccgcacaaaactgtaactaggcaagagacatttcatacaggattcttcctgggaagctaagaagaagaacctccctcaacatggttccttttcctgtgaaagatgccactgatactaggcaagagaactttctttgaaactgacaccttccctttttctaacttcatctccaccttgtttggaggtgaattctgcatttgaatcctatagtgctgtggagaaagttctggggacatcagtgtttcagccaatattcgagatgcagcttctgctgctttcttctgctcttgttcgcgccactttctgagctcaccctccaccgccctctttgctgcttcagccatttcagcccttttcaacgctgcctgtgtttcagtcttcatatcctcaatttccttttgggtttcctctaacctttttagaaattcattttcactagcctttgcaacttcaacctgtgctgtggcagcagccacttttatgtctgctaatttatcagactcctcaacctttttaactaagcattcaaactcctctcttgagattgtaattcttgcaccaggttcagaagttgatgaataagaaggactagtcctcatagataaaaccttaatctgatcaagagcacttgcctctgctgctttagctgcttccacttcttccaacactactttaagctttgtttctgcatcttctaacacaagtttagtgactgcagcttccatcttcaattctgctgcctcattcttcataccttctgtttccctttttgcattttcagtttcagacaacaactgttttaatgtcaagatcatttcctctgatgcacctctagctttagattcttctgccaagtaggcttcgagtttagactcgcttttccggagctctaccctcagattctcgacaacagattcagttttggattctttctccttcaattcagagtgttctctttttgcattctccagctccatcctaagagcttccaccatgcttctaagggagtcttcctgtcctactactttctgcagtgattccttagcatcaccaagctccagagtgacacttttcaaagagtccaagtctgatgtctttttatgttcaatttgcttttgcagaaccacaatttcagtcattgtctcggtcagctgcacttcaagatttttggtaagctctggattgaattccttctttaaatcaagcaacttcttttttgattcttcaagggtggcttcatatgattgtcttggaactttttgcttggctaatgtctcttcttgaagttgatgtgcttggacagattcagcattcattttctcaactgattcctgtacagccaaaatttctttagatagctcacatgctttttcggtgtttgccttcattgcatcttcagcttctgctgcttgcttgagagcagaaactcttgctttcaaggataaatcatacccctgacgaattttactcagttcttgcttttcaacatcaagttctgtaatgacagaagcataattattaagggcagtttctaactcttctttccaagcaccattggttccaccaggatcaccacatttttcttcaagctgttttgctttattttttgaagcttctgttgcctgaattgctgattctctggattcaccgagaactttaagcttttgtgagagatcctcaaccactcttttagccttttcaagctccaccaggacttgagccttggtagtttctgcattctttagttgttcctttaattttttcaggtctttctgggctaagtgaagttgtctcacctttgcccaaacactctaatgaaataacaaaccatagaaacaattttcacttatgtggtaaatgagagcatgtcattcatgaatatgatacatgttaacaaggacatgtcattggcaactgaattaaagcatgatactggattgtgttgaacaattgtcaaattttgaagtccaaattataacaatatagaagattttgaactaataagaataaaagtttccaatttttttcacatttcaccccactcaaaactttttccatcagaacacgtggtgcaaacacaaatttagattcatagtaacctctacaccaattctaggaatgagttttacactaaaactattggtccattataattttgtctttttgatatgcaacttcagaattcagatatagttttaaaattacggtataaaaacagttacctcagcaaaatacgattttgccttcttaatgggagcattgggaggtgtttcaccagagaaagcaccttcgccaaatagagaaacagcatctttaacagattgaaaaggtggactggtgtcaatctctccaaccactggttttgtgggatttggagagttagcagcactttgcctgattttggctaccatattgtcttttatttaaataatattaacggcctttgaagccaacctgcaaaaaaaaaaaaatgttacagtatgaatatgatcaacacaacacattgtaaacatcaaactcaatacaatcacacatatcagagattcttttcaaatccacacaaaaagcaaccaccaagtagcctattcagacattttaacaaaaccccatcaacaaaaccacatcaaagtttccatctttagctgaatccacaagaaaaatcacctacaaatatcaaaaagagtaggaaaaaaaaaactttcaaagaggtgcttcttgaaaattttcatgagaagggaaagtgtgacattgaattgcagagtgaaatcgcgacgaagaatgttcacataattgtgaggagggaaagaaagaaagagagagagagagagagagagagagagagagagagagagatgagtttggttgaagtgaaaattgcgaaaaggtgcggtgtgtttaaagacaaattttgcatcagcatgtcagtttcagactcaagagtttaaaagggaataatcatgtgcaacttgttcctattcaagattcctctaattcagttataatggttttaagatcatatatgttatccgtagcactatgcaattgtgacttgtgaaaattctgtcagaataaaagttgcagtaaagatggttcgccacgtcaccaccaccctcccttcacaatgaacaaaggaaattttttatttaatttatttaaaaaaaaatgagagtgacggtgatgtaaatcagcaagaaggcaaaggacaagctctcttgtcctttttcaacaatgtgtctcgaacatgaacatttgctagcaattatttgggacactcatgcttcatgcttcatacttcggttgcccatatacatcctcttcaacggtgatatcgagtagtagtaattcaaatctaatgcataaatatgtattatacctatacgggtaataaataattttcctctaaaaaaggggtaataaataatttatcgcatcgtgatttgattgtatagaaccgaggcacggatttgcacagggttactatttttattttttaagtttgttatctgatttaattaattataaaccacccgggttgatctagtgatagaaagtttagaataattttcatgatatcctaagttcaaatatcagtgagatctttgtagattaatttaattaattacggattgagattgtttggcatcggattccacttacaaaatttgagacatgaaaaaaagttacacttatatgaagtttctaattctctggttcattattgttcataggagaatgatttgttaatgtattggggccgaaacctcagaaaataacatggcaggtatatataagtcgccttctattgtctgaatggtgggacttggataagtctgcttgacctacaaatggattggagtgggcattgggcagctactaagtatttaaaggcccattatacttaatgcttttgctttcaaatccttttgttatggttattttctacttccacacctacatttcactatcaagtgaggaggatatgcccaaaatttgtactagtctatatagaaacgtgtataaatcacgatagttttagttggctttattatctttttacggtctatttaaaagaaagaaatcattatttaaattattttaagataattatattaaaagccaacaaatttatcatatattataaattatgatgagatgattgtgtaaatttttttacagggtataatcttttttcttaacaaaatacattttaaaaacttttgaagattttggaccatgaaaaaagttaattattttaaaaaataaatatttgagtagcttttttaaaaaatatattttttaaataatttccaatttattttaaaaaactgaaaactaaaaacaattttaagttatttctatttttactctttagcaaaatacaaattttacaaaaagataattataggtatttttgcatacacatccatagactaatattcaaatatttgtctttatgtacgtacctctgtttaatttgatatcgagaaaaaaaaaaaaaaagagtttggagaaagggataaatagaattttcttcattaatttaaatgagagaaaaaaggataaaaggatacaaaagagaaatattcattttttttcctttaaagagaagtgaaaaccaaggagggaaaatggaatcattgtttgcatgagagtaaggcagtgatataattaaagggttgaagttgaggtgaggcagatatactgtcgaaataccgtgatagtatctgctgcatgatcattataattgtcaactcaatcaagtaagctacgctgtcgcgcgctcgctgcatagatcatgattaatagctgcatgcccatcattatcaatatttctctattaattgattagggtatgttaccagtaaacgagtgagtaattaatgatgattcattgtaaatgatcagtgtcgttaatgcaaccaagacgattcttcaataaataaaaaaataaaaaaatagctaagtattacattaatttccaactgggttaacattaagcatatatgaaactacaagataatactatctccacctctgtgatttacttctcctttctaccaatctgctccataagcaagagaatcatctctcttgtaattaattaaatttcccacactagctctaagttaattgaagtctgattaacgggttttgagattgatcttaaatcccatatataccctcaagaattcatcatagctgctagttaactagatatttgtatcatgcagactccatattattgtggactttatatagagagagatctgaaatgtcatattgggagtaaatgaaaagcatatccagtagtacaggtaactgaaattgttgtaagatcaaataataggcataggtagtgttgcagtatatattcatatatactactgaaactagtacccagcagggaattatgtttccacttaaaaagagctagtaattaaccacacagggaaccaaatctgacagaaggatgtcataaacaaatatcagttttgtggtgcgttttataagaatgcatgttaaatagttagtgaaactttcgagtcaacttgtggattccaacactttacatttcttggattactaattgggctttcgaattaaatttgatacatctctcatgttttatacaattatcttctttactgaatgaaacccaaaataacttagtctgatatatacagagcagatggcaagaaaaaagaagaaaaaaatggagaatgactagctaggaaaaacaattgcgattgtcattgtacatgccacaaaaacataagacaactcagttcttaataaagcatccaatcaaattaaaacatccaacatagctacaaatgggatggaagttgctggacattcaaaatgcacaacagaaaaaagaagcctaaattttcatgacgaaaattcgtagtttttcttaatcgaattcaggtgacatatttcattttttttttttaattttctattttatgataaggctccaatgaatcagactttatcatcattagtattatcatattactaaagttatatttttattattattttcacctataacttacgtacattaaaaaggctatagcttatcataaagatttatttttctcactcataatgtcttagtattattatgacttattattttgatgtaattaattattttattctagttgaatgtcttcttaaggctcaacctttgggattttttgttttgtttttggtacattcaacctttgggctttaaaagaatattatcttagtgttaagtctttagtactacgatgttactgttggtcccaataaaattactcctagtccctatcagtcaaagacaattatcaaactacccttctccacctcaccccaccccaccccacccttcccaaccccaccttgcactcatgctgccatgcttcttttttttttttttttttcgtggtcaaacgtaattatactttcgttgtgaaattttgcacaacgaaatcacaattttgttatttttggtgttgttggtgcacgacgaaatcattattccctttggggctttaaaagaatactaccttagtgtcaagtctttagttatagggtgttattattggcccaaccaaaattgctattggacccaacaaaatttctcttggcccctatcaaccaaagacaattaacaaactacccttccccacctcaccccaccccacacttcccaacccctccttgcactcacgctgccaagtatttttttttttgtggtaaaacgaaattatacttccattgcaaaatttcgcacaacgaaatcacaaattccttatttccgtagttgttgatgcacgacgaagccatgattccgttgtgcaacaacaatccgttgcacaaaggaatcatgattttgctatatgaaatttcacactttcattgtacattttttctctccgaaagaatactaaacgaaagtgtgacttcgttgtacaatggaatcacactttcgtaatactgtcatgttttaaccttccttgcacaacgaatcatgattttgttgtgtatttttttcctccctgaaaaatattacgacatcatatttttgttgcacaaaaggaagcgtaaattctatgcgcaatagaatcataattttgttgtgcataaaattcacacccccttttgtgcagcaaaaacacgataccataatactttttggagaagagtaatcttggaattttgatgaattataggaatcaatcgcaactaccttagttattagtatttcaactaaaactcatttggaaatgatcctcctcaatgcatgtgtgtaagagggaaatggacatgtaaagagaaagaagaaaaaaaagaaattgagtccatacactaagctgtatttgtttaaacgttgagttcaattgaatgagaaataatatttttggataaatagtcattttcgtccctaaacgtgtaaagtcttgacaaatttgtccccgaaagatgaaaattcaaattttaatccccgaaaatgaaaaaagtgcgacaaatctatccatccgttaacttctgttcgttaccgttaatgaaagagcctacgtgacgcatttagagacgaatttgtctattgctctgaaatttctaatatgacagtaccgtacccaaaatatgagactcaaataaaaatgtatagccattaagttaatccttacaaaaaatgagactcaacttgattttgtcactgcctaatgttgtcacaataaaaattttaaagtaacagaaaaattatgtttattaatcaatgttatgcttattattatgtttgttttcctattttttaagtgtttattgtaatattatgtttgcaacgattaataaagggagaaagatgaagattaaattgtattttggataaatagtcatttttgtccctgaatatgtagaatgttgataaattcgttactgaatgtgtcaattatgtctttcattaacaataacaaatgaaagttaacatgtagatgaatttgtcgcacttttttcatttttgaggactagaatttgaatatggataaatagttatttttgtccctgaatgtatagagcatcgataatgaaagactacaacttccttccccgtaccaagaggctagagcatactggcacgttcgatcccttccttgcattccaactgaaacattctatcagctaggaagttaagttatttttttgacaagatatttaaattagtttttaatttttttattaattaaaaaacatgttcaataaacaaattttcttaatagtttctaatgttttttgaaatattatttaaagtaacattttttaaaatattactttctagtttttatattttctttcatttttatcctcattagatttatctaattttttaattaccctttttaaaataaatcatgattttattatttttcatcattttatacttttcaactactttagcaattaatttatcaaatacttataatttaataaattaattttttaattaacaactaatttttcaattttcaattaacttttcaaaataattttacctaacataaccataatcaatccaaaatttcaaggcaatatttttttttaacacagtgccaatatattgcatagaaatacaaaactggggggtgcaagattaatgaggataaaagagaaatgagagcatggttgaaattgaagcatgcaaatgcaatgcaaggaatgagacaagaagaaaaaacaagatcccctccctcttacatgcacttgctaaaacaaaacaaaaatgccagacaactgaagggttacatcgcttgtacacaaagcctcacgcatttttaaaaattttttatttataaaaataacaaataaatttgttgaaaatatcatttattcattaatcattagcaaaaaaatatttttcatataactttttttcattcccatccaaacaagcggagagaaatttctttactattttctttcttatttatctattcaaacaacacaatttactcctaaactaaacaaagtataagtgagaggaggggagtaagtggtaaattcattctgctacacgctattattgtatatttgtattaatataaaagtttatatacaaataaaaaatataaaagattatattgtgtcttgcaccagatgaaaaatttaataataaataattaaatagtaataatagtctataattaattcccaagtataagttttagatatcaaatctaaccaaattttctatatctggttcttattgaatttaattgtcatacacgatgaatgtatatatataacaaatttatattgttatctaataaaaaattatgattgcatgacgtttaatataattattatgagaattaataaatttatcatatataactcatattaaaagacaatgtaaacttacatcgtcaacatagttttttttatcttttttatttcagtaagtttttgaattgttcatactattgacttgaccaatttccaatttaaaacgatacatgtgaagtgagtccgtttttcatagaaaaaggttacattcacaaacatatacaatagataaaatgacattttctgtatgttttttctcttcattttcttgatttacggaagattcaaagcactatgaatgaatgaccaaatcataatctgcgactgttattgactttatatattcaaaatacaaattggtacgtagtttaaaatcgacccatatgtcaatttgatccctctatatatagagagaaagagacattataaattaatattagcaattaaacttgtatatatacttatattatgcttataataattttttgtagaatacaaaattaactaatataataattgaatcattggatattatcattttgatcatctatgttacatttcacatatattatatattttttagtgttttatctagtaagtagatatttacttatattttataacagataacacgtgaaaataaaatagtgtgataaaataatattaactacattttatttagatttacttgaaattttataaactggtttaaaatatatatcggttagttatcaaaaatattttcttagaaaatagagtactacttaatgtgagtacatatgtgtagtattatttgaatatatgtatcacacatgagtgttgtcttttttatttaatttggtaatcactgtaattagagacttaaactctccaataatacctaagatatttttataaatttcagttctttaaaccaattataaaaataagttttgataagacttaatcatatttaaaattacattcatgctgacatagtggtaataggcatatcttaacgcatgtaccaatgtgtgataaataaaaaacactattcttagtaaaaaataattctagtagtattacaaccaatcaattaaagacactattaacgataagttgaatttaaagaattatttatgaaagtttatatattaaatcttaataagtacactcccgtagtaatactttcgaaaattctccaccacgttttgtccattttgtggaaacatattttattgaaattttattaaaaataatatctggcctgtataagatgataagaatacgtgaagaatattaatttcttatgaacaattatatttggaaaccttgctattgagttccatagaacaattttgagttcgagttctaatttacatttgggttattaaatgtgcagaggaaaactttaatcaccgaatggtcatatatattctaataaaacctctactatttctttatcttgctaaatgtcaaataacatataacaagttattaattacaaactcgtaagttgacataataatctaaaattacaaactcccataattattttgaccatgttttgtcattttgcggaatcatgtttgattttattttttgttaaacataatatctgcccagtgacaagtataagatgataagaatacgtgagcaccgatattttgagtaaatgattatttttatttttatatgtataaagtgttaataaatttatttttgatagataaaaatttaaattttagtcttgaaagtaaaaaatgtgataaatttatctattcgtcaatcattattaatgaaagaatctatgtgatacatagagacaaaaatgattaccaacatgattgctaaatagattggatcaaaatgtgaggaagtttttattggattaatttgttagatctcaaatttcgtttcatttaaaggtaaaatataatttaatcttcatctttcttcatatttttttttatcattgcaagcacaacattataataaatattttaaaaaataagaaaacaaatataaattagaacaaatataattataagcataatatatattgattaattagcagaatttgtcttttgatttgaaatttctattatgatagtattaggtagtgaaaaaaattaagttatgtctcatttttttataagaattaacttaatgattgtataattttgtttgaatttcatattttggataaatatattatcacattagaaattttagagcaacaaacgtctaatttatgtttgtttttctatttttaaatatttattgtaatattatgatttcaacgataaaaaatgggaaagataaatattaaattatatttttacccttaaatgaaacaaaatttgggttcgatgaattagtccaatgaaaacttataacattttggttcaatttatttagcaatcatgttaacaattattttgtgacatttttgtctttatgtgtcagataagctctttcattaacattaattaacgaaaattaacatattaatgaatttgtcatacttttttttactttcaaactaaaatttaaattttcatctttcaaaaaataaatttatcgatattaagaaaaagactatttacgatgatatttttattattcggtccgcgatgtgaataaataacattaatagtccataccatatgtaattgtccatctccctttccacacagcacaaacacagaatctcgtgagaaagaagctgggagacagaatgagagaggaagaaggtgcgagacaacaagagtccgatgttgatgttagtttgttcgagacaaaagaagcaagattccgaggagtttacaaggtatttgcatcaacaatatttgcagctatatgttttatttgggtgtacagagtggcaaacatccccacagttaaaagtgggaagtgggcttggattagtgttatggtgtcagagttgtgttttggattgtactggatcatcactcaatctgttcgttggagaatccttcaccaaacgcctttcaaacacaggctctcacaaaggttactttttcttcatcctctccttttactttttcatttttttcatgtccaggggaaaatattaaacatacacatacgtatagtgcttttttgcttacattatttatctcatttattgatttctctcacttgcttcatttccactcgtacaccttaaaattggacgaataaaaaaaaattatattctgtgagcaatatttataaagttaaaataacttggactgttggtgtaaaaaaatttacactgttaattatgataaatttttgttaatataattattaagataatttttataaagttaataaatttatcatttatatatatatatatatctatggtgaaaatatttatattatacattgaattatatattacatttcacatcatgagaagcatttgtatatttacacatgtgtatggagtacattaaaagaaaaaaattaaagatttgtggggacaattacccccaaagtataccaagtatatctgtcctgacatgtgcaagtatagaaggtggaatagtgtagggaaaatgaagcatagaaaaaaatgaaaatcgtgataactactataataagaagtatataaaataagttagaatatatatatatatatatatatatatatatatatatatattatcctttgagaatgacgatcaaactgaatccttgcaagatgcactcaccacactgtggtgacttcaatgattgtttttctccctctctctcaataatattgtttctaagagttcattcaatgtagtgaaaagaaatgaaataaaaagaaattgataaaaaaatttaaattaaaataatacaaaaatataggtctcgtattttttttctcactttgtatatttctctacgtacaaatgaacgaacctaaatgtctttcattcttaactagaactagaagtatttcattttcaactatataagtctattttcttaatttgatattcatttaacaaaaaaagtgaaaggaacatggaccgctgaattaaatatactcattagctaaatcacattaagagccactgcaaaaaaggctaatggaatcacgctcaatactactactttacactctttcgacttttcaaataaatcccatcaatagccagtaagaaacaagcgaaaagtctaacggagtagtatcgtaaaccaattaccaaataaattaaagacctaaagactaaacattgcattgccagtcaactttttatactgtttcattccctccagtggtcctatattccatttcacaaatattttgtgaacataaatataattaagtataatattaattttgtacgttggaataatgtgattctttccggaatccatatctgcggcttctatttatttatattttatacataagaaaattatattattcgagtatagtgtgaccgaaaataaattgacggatgatgacttatcctagttaggtttcagcttttgcatcatttttggctgtatataggatgtgtgcatcgccgactgtactaagtaactttgtaattagttctggtcagggtgtaagcggattgggtggcaaatccgtaaaattcaatttaatctattttttattattattttaaattaaattattggattgcatttattttatttcagtaaatctaattaaaattaaatttgatagtaagttttgaattttagattcaatcatagatcaatctaactcatatgtaattaaattactaatataaaaattttaaattgaacatattttattatttattttaagataatacactattttataaatagtagtttgatcatacatttttttcttgtttattgtatcaatagtataatatttttaataatgatttctaaagatatctttactattttattaaaaaaaacattcttactatttttgggttttgagaatttttttaaatatgacaatttttttatgatctaattcgataattaacctaatccaattaaattaaagttgaattgagttgaaaaaaagaagataaatccaatttaatcaaatccaattgagtttgattggattgaattgaaaaattgattttttatcaatttaacataggtcacttccagtactcttagttgtaggattaaacatgtttttggtttttctttataaaattttaaattataactttggtttttataaaattttaatttattttttgctagtctcttctctatttaattttataaacattttcagtttttgttgataaatgagaagtgtgtttcgtgtcagtatgtttaatagttatatatcactatatagacaccttgcgtgatctagtagtcatgtgatgttcatatctatctattaacagattgtatgatacgaaatcacatggcaattaatgtgatgacgtacggcgcatacaacttattaatttaatctattcttatttgactaattttagtcattttaaatatataatctattcttcagttattttcacattcaactaactaaatcattatataattttttattcttttttataagacattttgaacataatcatatataatcattaacttattatgaataatattaaaatttaagaataatacatattactattaataaaaaaatattaatacttagaatatttaaataaaagtaactagtattagaaaaaaagtattgcttagaaattataaatatcttataaaaaatcatcaattctcctaaatgatgtgttataataaggaatatagaaaatatgtcacatcatagtatcatccataccattattgaaattagtggtgaaggtggaaatgtcaaaatctctattgcattctctctaacgccctatagactatagtaactaatagagttccaatacttcgaactctgattaaacaaccttcacaaactttggaaataaagtcttggagatatatatatatatatatatatatatatatatatatatatatatatatggatttctttgttataattaatgagtttcaaacttgatatttttctttaattattacatgatgcatgtcagttatatataataaggcaaagttaagtagagttgttccagacttgaattagagctcaatgtatgttggatatttgagtgtgtgtcttattaaattttattttttcaagtaattgttatacgtaaaatagtaaaaatatgatgaatattttttggcatgtctttacagatatgacgaggagaatttaccagcagtggacatttttgtgtgcacggctgaccccatacttgagcctccatgtatgacgattaacacggtattatcagcaatggcatacaattatcctgcgaataaattgagtgtgtatctctctgacgatggaggctcagagctaacattttatgctctcttaaaggcttccattttctccaaacattggttacctttctgtagaagattcaatgttgaacctaggtcaccagaggttttcttcgctgccccaacttgtagcaataataccactgagtatgtccaagcatggttatttatcaaggtaactgactttttttttttttacgttgaattatcgatggttatatatgtccatatagtgctgtcttcaaatgttactaatattgttcgggcacggtgtgcttgtgatcacatgaaaattcttggagttgaacaattgatgtttttaattcaaaggtttgttatacggaaaggaatgcattagaaaaaaaaacaagtattaaataaattaatgaatgtatatttaacatttgaaaggtaacaattagttaactaattagtgcaggtaatagatatatagatacaatgagctgagcgcatagatcaattgaaataagttattttagtttaatcagatgtcttaaatttgtattttatatgggatctataaaaaaatatatatctaattctcttaaataaaatgttaaatttgagttttatatatgaattcaaaatttcaaaattaggttactgaatatttttaactcaaataagattgtctcatatgtgaaaaatatatatacaatattaacaaaaaaaagtaatttttattaataaatattaattattaatttttgttagtgaaaaaattcaaattcaaattcaatacaaatacgttacttgttatttgtttgttttctatataatcagtttttaaaataaaaagttaaatacatatcttattgttttttctttaatttgttttgcctgattctgtaaatgttactcatttatacgaattaagacataaaaagtgagatttcattctttgatgaaaaatttccccattttccatttcatatatgtcagaaattatacgaagacatgaaaaatgagattgaatcagctgtagcaaggggcaaggttccagataatgtgaggaatcagcacaaaggattctcagaatggaatccaaaaacaacaaaacaggatcaccaacctatcgtgagggtatggacatttttaattttcacaaaagaataagaattcacgttggaattaatctactatcttagttttctatataactaatttttcaatataatctttattcttcattttattagataataattgacggaagagacacaaatgctgtagatgaagacagatttcaactgccaagagtcgtatacatggcacgcgaaaaaagacccaactaccctcaccacttcaaagctggagctgttaatgcactggtgagtaatactcacagcaatacattaacagtgtatgctaattaaactcataaatttatattttacttgtaaaaatgtatttcgttttaatttaaaagaattaaatcttaccttacaatttacaaatgcaagctaacaatatttataaaaaaaagttaattaactctttatctaatatatttttttcacttaaagtgtcttaatactttaattagatattaccctaagctttgcagttaagctaaggttttttttttttttttttttgaaatagttaggctaaagataagaaccttgaaaattaaaccctttttaagtttttttattattatatcttagtatactatgttttccactcactttataaacttgtcttttgtacattgatgatgatattttcaaattgttcattcaaagacgtatttgactatgtttttccaataacaacaaacaaaaaagaaggaaaattctctattattatttggtgttagtgtcacatgtcaaaagtttcattctgcagataagagtgtcatccgagataagcaacgcccctttcattctcaacttggattgtgatatgtactccaataatgcaaatacaattcaagaaatactatgcttcttcttggatgaaacaaaaggccacgatatagcttatgtgcaatttccacagagctataataacatcaccaagaatgaccattatgcaaattcttatcttgtgagcagtaaggtaaataataaaataatgtaattactttatagtttatacagtatacatatatataaactcacacataaggatggaccaacagtatattgagtctgattttcttaatatgtgcatataaagtttgagctagctggcatatgtggatatggagcagccttattttgtggaactgggtgtttacatcgaagagaaagtctatcaggagcttacttgatagattacaaagcaaaacgggacctgaagcctaaaagaaatgataatagaacaattgatgaattgaatgaagcatcgaaggctcttgccacttgcacctatgaggagggaactcaatgggggaaagaggtttgcgctcatgtgtagattttaatttatctcagaaatttcaatatttaataatatatatgaatcttgcagaagggattagtatatggtattcccgtggaagacatagctactggccttgtaatctcatgcaggggttggaaatcgatttattacaacccagaaaggaaggcttttgtgggcatagctccaacaaccttggatgtagcatgtcttcaacatatgaggtggtcagaaggcatgttccaagttttcttctccaagtattgccctttcatttatgggcatgggaagatacactttggtgtacaaatgggatattgcaattaccttttatgggcccctatgtctctgcctactctctgttatgtctttgtttctcctatttgcctacttcatggcattccactgttcccacaggttatctcatgcgtttaattagcttgatttgattgcttaattttcttgcacttatttacctctaattcgtgtttttgcagctttcaagcatatgggtccttccatttgcatatgcatttcttgctacatatggctttagcttgtgtgagtatttgatttgtgggtccacggcaaagggttggtggaacttgcaaagaattaaattcatccataggaccacctcgtatctctttggtttcattgacaccatgaaaaagcaattaggactgtcacagacaaaatttgtcatcacggataaagtggttactaaggatgtccaaaagaggtatgagcaagaggtcattgaatttggaggctcttcaatcatgttaaccatattagctacagtggcattgctaaatctttttggtctcgtttggggaatgaagaggattatgatggatttggaattcagctctagccaattgatgatgcagattacactgagttcattggtcgtaatgatcagtttaccagtgtatgaggcacttttcattcgtagtgataaaggttgcataccatcttcagttatgctcaagtccattgtcttggcttcattagcctgttgcctagcacctttcatttgctaatctagttaaatgtcaaagtacaatactgaaagtgtggttcatacttactagtgataagaatctttcttagttcctagtttggcttcattgacttgaagcttcaagtatgtgcgctaattatctttattagagtactttggtttcatgtatctaaacatacatctagccactattatttgttcatggaaaccggacattgagattcccaatatttgatttacaagaaatactagcaatgcacatttcaatattatatatttgacatactcccttctgttagggaaattcatgagacccacgaattatgtatgtctgcttcttcgtacaatagatattgttttcaaattggtatgattttaggaatttcaactaataaaaaaaatgagtcgaaaaaaggtgttagataatatatatttgggttaattagacatacacttctttatatatttttatactaatatgtttaatttctacattttaagatttacctaattaaatttaacgtccaggcactatatatttggtaataacaattattttttgttacataactatttgtttcattttgttcgtaaaattaatatttaaattattaaatatacttaaaacatgttctaaactaattataataataagttttatattaaacatacggactttttgacgaaaatgagaattttggagaaaggaaatatgcaaacggattcttttaagaagtattttcatgtttcagacattcattcattttccaagtcttagcaaaaaaagtaatttctgcatgtcaattgtatgtaattagaatatatatatatatatatatatattattgaagttatatttataattatgtaaaaagtaatttttatatcgattacaaatataaccgatgaaacatcttttacatcaattatatatataatttatgtaaaaagtaaaaaatgctaatatttgaagacatgatactagcggataagtagtgtctaaaacaaccctattatcattgtaaatacttctaaaaacaatccctttccatatttacttttgtcaaaatctcattctcgttaaaaagtcaaacatatatcactgatgaaatagagaaattcttgcttattctatgagtaaggtatttttcttgttctgtaccatttattatataacatgtaaataatatggatcattattgtcttctatattaatgagtctttttaattcttctaaaatattaaccatagttaattttaatttttctaaataactacactaaagcaaaaattttctcttgaaggtgttatgggtgttgatataaaattcataaaattaaatatattttaaaaaatttatttaaaaaagagaaattgatatattttaaaaaaatcatccaaacaaataaaaaaaattggttgcattttttatttttttagtagtttttgatttttactttagataggtttacatttaaacaccccaaaaaaataagaaaaaacaaaagtataataaagatatttttgtaaccaactcataactatttagtttcaatcatgaatataatattacattgtattatgatgagagaaaaaattacagtataaatctgctattaataatgaacacgtatttattggaaaaggtaaaaggttgcaaaaattatttggggactagtgacgcataatcataagttttatattggaaaattttaatcttccatttaaatatgacgttaaacaagttataaataatgaatttgataaaatttaaatactaatttttgtcaagttaaagttttctatcatcataatacaaagtaagatcatattcatgattgaaactaaatagttatgagttggttacaaaaatatcttttaagttattatacttttattttttcttatttttttggggtgtttaaatgtaaacctatccaaagtaaaaatcaaaaactgctaaaaaaaataaaaatgcaaccaatttttttatttgtttggatgatttttttaaaaatattaatttctcttttttaaataaattttttagaatatatattaattttatgaattttatatcaacaccttcaggaaaattcttgttttagtgtagttatttgaaaaaattaaaattaattatgattaatattttaaaagaattaaaaagactcattaatatagaagataataataacccacattgtttacatattacatagtaaatagtacagagcaagaaaaatatcttggtcatgaaggaagcaagaatttctcaatatgaaataattaattttgatagtaagcggtgggtacaaaatagtaaagatttaaatatattttaaatttataaatagagtttggcggttagctttgtttttagcattcttttttgtttcttggcaatatatatatatatatatcgtggctatatgtgctgtcaatgggttagtcagtacatttgtgatcacccttttagcttagcttggagtgttgtactgtcaatgcaacacccatcacacaatataagaaatatcaatgaataacatattgctccattgcaaaaaatttaaatataagaaaaaaaattaaccgactgcaagtgcaacaagaacactggatagaaaacttgaaggtaatggagagtggtgaagactattcactgtttgagactaggaaagacaaaggaaggcacattcgaaggatctatgcaatctctttgtttgtggccatatgcttcatctgggctttcaggttgagccacatacccgcatatggcaaatgggcttggcttggtttgtttgctgcagagctctggtccggcttctattggctctttggtcaagccctccgctggaacatgctgttcagaaaaaccttcatcaatagactctatgaaaggttcaagttcgatctacacctttaatttgttcccgtgtttaagaaaacatttttttgattttttttttaaaattattaaaattgtttttttttaatttgttacaaatatttgtgtatgttttaatatctagaaaaattagaaattacaagtaattatatattactacccaatccaattacttaggattggagtatttataaatcaaattttaacctgttaacctaaacaatcacttaaattcagttggttgagcattatatatgatgaattattgtaaatttcctctataatgtgtgtgttttaatttgtgatagatatgagagtagcttgccgagagtggacatttttgtcttcacggcagacccaatcattgagccacccatgatggtgattaatacagtgttatctgtgatggcttatgactatccagcagagaagctgagtgtgtatctctcggatgatgcaggctcagacataactttttatgctcttttagaggcttctacctttgccaagcattggatgccattctgcaagagatttaaggtggaaccgaggtcacctgctgcttattttaacacccttgtctcaacaaattcacacgaccataaccatgccaaagacttagatgccatcaaggtgcggagtaatcactttttttttttttttttttttgttcatgtcacttgttgccaatggaaatccctaaatttgatctaaatcttgctattgttatgtacataaggtttgactaaattaatcaagccttttatacaaattaactaattatttaaaatttcaaattgtttggaggtggttgaccttggtttttatttataatgatacccttgttaattagacatatataattttggttataaatgacaatctcattaattcacaacttttttgtaattaagttccatttaagtatctaagttgcatttttttttagaataaaaagttgtataacaagaatatgtcatgagataaattttaaaaaattaaataaattggtttgcatactctaattattttgtgaaggttgcctattttcttctcacaacagtgtgcttttattttgtggtagaaactatacgaagatatgaaaagacgaatagaagatgtagtcaagttgggtggagtacccagcgaagcaagatcaaagcataatgggttttctcaatgggattcgtattcttctcgacatgatcacgatacaatccttcaggtgaattatactttctcaacattttctataagtatatatttgagagaattatatatcgacatgtgtataaaattgttaaacaacttttgttaaaaagatattgtcgttctttacacaagaatgtaagttgtcgtgactcacaggaaaaaaaaaatctgcacagtaactcttagcatacttagctttatttagttaagtttgggagaagttaattagctatataagttagttaaaacttatttgaatacaagactagaagtgtttatgagagtttttctattggaaacctaagtgtccaacttatagcctcattgtatataagcttgtaataactcttctgtaactaacaaatcataatacaattgatcattcaccacttactctcaatttctggtttcttcttcctcaagttattgcttcttcactcttcactttcagttgaacttcatgagtaacaaaactactcgtaaaaggaattacacagaattatattaagaacatatttttcaattaatctatgcaccacattgtttttcaaatttataccatatgaagttcacatttttgtcaataattttgaactcaattcggctcatgagttttgtgttgtcctatatataagtttgatgcatggtttgctcttgtggcttgattttcttaccagatactacttcatgaaaggaactcgcacaattcgaaggatgtagatgggtttgttttgccaactctggtgtatatggctcgtgagaagagacctcaatatcatcacaactacaaagctggagctataaattcattggtagtgtatataattaaaacccgcctctattttttatttaaagaatttaggatgaagaatagtacctcaattcatgttagaaaaatctttcaacttaaaaagtatttataaggaacttaattacatttacttcacctaaaaaattgatcgaatagaagtttaagcctactactgggtatatgtaaaactgtcttaatctactcaatgaatctcttgtggttaaaacatatacagtttcatacgacttaaaaatagcaaacaagtaacatggtgcttattatttattatttacaaaaggaggttcacaaaaaaaataccactgtatatatgagccgtaagtggttgaatcattcttgcgatcttttgcgttatagattatagattatttacattggcacacatcgtcaacgatctaattaatcacccatgtgcatgagtgtgtctatatatgctgcctaattatgtgtgtgagtaactttttatggatcatttgtcaatccatgtggattaaagataacattcttttcattgacctaaatgtagctaagagtctcttcaacgattagcaacgcgaaaatcattctaattatagattgtgacatgtactcaaaccattcacaatcagtgagagatgctctttgttttttcatggacgaagagaaaggccaagaaattgcttttgtgcagtttccacaaaattttgagaacctcagtaagaatgatttgtacgggaatgctatatcagcaattgtggaggtgagttagataatattgatggaatggaatactgtttttccagaaagattaaattcttccatttgcattacccctgtttctatttgatttcatttgtagatagactttggagtataactattatatatatttgtctatttgttttatagatagacttttgagtataactattatatatatatatatatatatatatatatatatatatttcaatttgaaatgtacataattttagtgaaaagaatatatctgttgtgatttctttaatttagacataactaatagctattaataatgtccactaattatttaaatgcttaaatatggttttatttctaataaatatcgattttttgtgtttatttctcaataaatttttgttttacattgagtgtttgataaaataaaatttttaccttttgtcccttacacttattttagtatgataaattagcaaattttatatttgttacctaataatttttatttatttattattagttgagactaaaacgaaatttgttaatttattagggaacaaatataatttttttttaaaattctttaatttaccatagacgaggacaaaaaacaagtgttatttttattagaaattcaacataaaacaaatatttattagaaaacaaacacaaaaataagatatttattaaaaataaaaaacatatttaagtcttatttaaaaataataatttcacatttatcacgaccactatgaaggtggagctccatggtgcggatggttatggtggccctttgtttattggaacttgttgctttcatagaagagacgctctatgtgggaagaagttcaattgtcaatacaaaaatgattgggatgatgagaatgagaaagaggtgattaaagcaaacttgcatgaactagaagtggaatcgaaggcactagcaagctgctcctatgaggaaaatactctatggggaaaagaggttgtttactttgatctttctctctctgttttcaaaatcacaaacacccccaaaagccaataataatattaatagatgagtatatatacattaaagtacaataatgaataatttgaagtgtgtataacttatttctttgtagattggtgcaatatatggatgtcttgtggaggacgtgataacagggttgtggatacattcacaaggatggaaatcaatatattacaacccagcaaggagggctttttttggaatagctccaactaacttgcttcacacactagttcaacagaagagatggggtgaaggcgacttccaaattttgttttctaagtacagtcctacatgctatggtgatggaaagatcaatttaggcctattaatgggatattggcactttaactatttggcaaccacttgtttgccaatactatattactccatcatcccttcactttatctccttaaaggcattcccttgtttccaaaggtaataatgacctccctttttctaagagaatatataagagatttgcaacattttattctctcccaaactccttatcaaatataaatatacattataaattactctaaatttatattattttggagttgtcaatagatatgattctataaattattttttttacatctttcagaatttcatagaattttttttattaaccatttgatttcaaaattgtttttttattccaataaaaaaataatagaaaaataaaatttaacgttaaaccaaatctcaattattttatttactctaaatttaatttaatgttctttttctattattttattttactcattgttaaaccaaatcttatgttaaaaaaaacatttttttgccacttaaattgataagaattagtggcctattagaggccgtttcatttaatcgagttttaaaaggccttagttttttttttctgaaatttttctttgcttgagtcttttttttttaattatatttttttcccgtcaatttctctattttgttcaaagtacaaatttttcctttgatatggactttcatatcttattatcatttttctatcgtcaaatgttaatttagttaaaaatatgtcggcagagattagaaccagcgttctcttccccctctcttttcctttcatctttaaattcttccttctcaattattaggttaaccttaaatctcccttattatcatttgtgtgttagtccttattgaaaaatgtaacagaatagattaatggatttttaatttaagtagtctgtttatttgtaaatattttgatactttaggcttatagtccttttacttatacattcttttatttagttttaattcacgaatgtgagacttgttttctaataattgatatgagtatgaaatcgaaatgaaaaaaacttttcaacgaactaagtaactttccctaaaccatagatatgttacctttgaatgaccatctgataattaggttttactacgtaatatacctagacacatacatgtgtgtgtatatgtataatttttttcttctctaaatgaatcttttgtgttgagaatgcaactaacattttgtgcttaatatgtgggttaaacagatgtctagctcatggttcatacctttcgcatatgtaatactcggggagagttcttctactttgattgagggtttaatttttggaggcacaatccagggttggtggaatggcttgaggatgtggttgtacataagaacaagttcttacctttttgctttaatagacattgtcttgaaattctttggacgttcatattcatcctttgctgtcacaactaagattatagaagatgatgtttcccaacgttacaagaacgaggtcatggagtttggaacctcttctccatttttcactgtactaacaacacttgcattactccatttgttttgcttactagccactttaaaagagttagtcctttgcagagttgctttaactggtgagaaaatggcattgcaagttctattgtgtgggtttttggttctcatcaatttcccaatataccaaggccttttcttaaggaaggacaagggcagattgcctagctctcatactattaaatctactacactggctttaagtgcatgcatcttcttcaaaatatggaattaagtatattaaggtagtctctgcttttaccttttgattggatttttttacaatcacaatgtagtattgttttggtggaatgttagctttcaaatgataaacaatgtacttgtggtgtttttagttggaaaagaaaggaattttattgttttccaatgattttatttttataatttaatggatatgcactgttaatgtatacaaaaaattactttgtcaacaaatcaaaaatcacttttggtatgacttttaaagttgttatagtaagagttaataaatttatcatgtatgattatttgtaatttatgactagatgacatcataaaattgtttgcattattagtgcataattcattttctcttatttttataacatttgtaacagggtattgaagctggtgagagtgattgccaatataaaatggatgagtcatgaacaaggagtgactcttggaagataaaaaagatcattaacaaaaaaaacacatggatgaaatgaatatacattggaattagaaaaatctaaaagttgtgcaactataagactatgtggttaaacatgacttaaatgaattgattaatattacatatattaacaaaatatatattttttgataatttatcatttaagaattttataattaagtatacttgatttggagcaatttttatatgagtaacctttgaaaagttttccatgatacatgtaacaggggtcaaagcatgcaaaaaaaaaattgtgttgattaattgggatattgattaatccggaaagaaattaggcattccaagactatattcttgtcaaaatataatattatatcaaccattttctcaatataaggaagaaacaaagttaagtttttcgtatctcatttcacttatcttaagctagtttagaagcatttaacacccctaagtttgtaaattaccgtctcagttttctagagtctggttatttctagttttatttttttttaaaaactaataattcaaatatttttttttttttatagacaatggcgttaatgaaaattgaaaattcttatattacatttttttactacaaatcatattaataacttaacctttaatttttttgttatgaaacttaatctttcaataaaaaagaatattaaaattttaaaatgttacaacattgttcgttttgtttgttttttcgttaataatctatatgtaagttatgctagtggttaaatcgaacaagtaaatacttgaacaaaggtcccctaatctatatttatattgattgataatgtaaaaaaaatataaaagtacacacacacacatatatatatatataatatgttttaatttttagataattttgaattattataatttattattttatttccaagatcaatattttgtgaaaaattaaaattttaatatttaacaccttgttcatattataatttgaaacaaaaaaaaatattcaagaaagaataacaataaaaaatgcctaactatattattttttaagattaaataaattttgggtcactcaaactattttatactctgatttttattctcttcaaatttatttcagataactaatttcagtccctaaaaaattatgtgttcattttaatttcttgtttatttttaatattcaaaactattccttgagaggatctaaaattgagaagaaaatgcaaaaacttaatctcatgggtcaattttaagcaataaaaataaaaaaaatgactaaaaatagataattttttttttaaaaagaaaataaaactagtcgtctgaaattagataggactgcaaaattttaagaggtactaaaaataaaatttaaaatagtttatggacaaaaaaatataaacaacgtgtaacaagcaaatctctataccagatagcaaaatgcaaggcccaaaagggagcaccttttgccccctaacaataaaccacttttatatatttggataagagtttgttttctttactcttccatctccatgttgcaaactcacataattcatctactaccctcaactcctatacttgagaattcgttggaagaaactagttacttataaacatgttttctgttgaatcttttacacaagagcaaccatgactatgactccgcaggaggaccttgtatgcaacaaaaccattttttctgaaaatcaaatgaacgttattcatgagaggggaaatgtaaatacaaaaaaaaaaaaaaaatcaaacaaattataggttcaacaaattatccctatactacatcaactaactatagagacaaaaattagatagttcattcaacactactagcagacatctagataaaggttcctcaaaccttttgaatgcatattgaatgaactatactaatcatctagatatcgaatgaaccttttagcagacatccagtcatctagatgcaaacatattaattgaatacatattgaatacaaaaatcagactatactaatcctcaataaagagatcaataaaagtatcatatttggttacaacataaaggttgtaattgaatcattgttgccatatgggtctttggatccacctaactttttaatcaaggacaatgttagcatcgtgtgtgtgtgtgtgtatatatatatatatatatatatatatatataggtagctcaggcaatcattctactgtttcttcattcttttgaaacataaatacattattaaccaagaaaagaaaaataagcatgtaaatgcgcgaatatcttacactttgtgttttgcttgaatctaacggaggtcttgtacgaggattattaacctttgcaggtgaatcaggtttgccacctgtctttttctcatttctagctttgttgaaaatcaccgtgtaaccttcagctgaagctggatcattcacatcccattcaccaaactttggtagtggtcgacccgtgtcctgagggttattcagatttgtttgtttaaaatataattaaactgaaaagccttatatgtgaataaacttgatatgttacatacttttttatcctaaaagtcagacaatcaaataagatcatgttaccaaaatcaagaaatggaaaacaagtttaattatatacgtgaccgtagaatgaaacaaaattattgtgaaatatgattcatggatataaggagcaaaattgaaatgaacaagcaacatgaatgagcaatcatagggaacaaattaaatgatcagaagtaattcatagaaatttgagatagtaagagaaaaatgacacacaccgacatgaatacaatgttggaagattttccggcggggggaaaatgagtgaggaaaaggaggagaaaatttagaaagagagagggcgttttaaagaaaatgaaagaattttggcgtttatatatatatgtaacgtgttgaacggaaatcaatgtgcggtggtgtagggagagactaaagaatgtgtgttgaaaaaagtaacgatgtggaatgggaaaggaaggaagaaatcaatgacgacgcatccacatgggcttactattggaaggtggaacgtctcttgaatgtcataaattgatttgattaatgttaacaaaaggttatttatttatataataattaatttggttacgtttataaatggtattttttatataattaattcaattttgattaaaaaatatcaattactattaaaaatgataaattatattacaattaattttattgctttaatggtaacttgcaattaaaattaaagatatattggattaagattttaaattcaatgaataagaaatgatggagtttggataaaaaaaattaaaatcaacataatttttttaatcttttaataactaaattgattataactttatgttctcgtattaattcttattgcaattttctcatttttcacttttggatttgaacaatagatttaagatttaaaattatatatgttgattttcttattttttttaatataattactacaagtacttgatgataaatttaatgacatatttaaatgggataaaagggagtgatgcggatgaaaaacttgtaggagggttactagttatgtgaatgataaaattaagagtgacactcaggaaagcattgcgagcatgtgatggacatagttaggtaagaaaatcatggttaatcttatcacaaaagataaacattaatttagaaagcaaatgaaaaagtgtggaggaaaagagtatgtttgacatttttttattccagaaaaataacataaacatatatgacacacacatcttgaagaatattaaagagagaataatatatgtgtaatgagagaaaagaaagtcagataaccaatagaaaaaaaaagagtctaacaaaatcttaaggatttgggtgagattgttttatactaaaaagtatgataaattctttttaaaaataattcatcaaaaattgtatatttttgaataccaaaagactttttataagttataaacaatcttaattgaataccattggattttgtagcctttattgaaaaatcttaaaagtcttaattgaatatttctatacttatttatacaatttaaaaatcttgattaaataccacaagatttttttattaaaaaaaaatcttttgaaatctcaattcagtacatctctttaattaaaatgggatgtaaaaaagtatataacggaaacatgattccattacgtattttttatgaaataacaatgaaatcatgtttctattgtgtattttttacaccctttcacacaaagaaaatatgattttgttgtgttgtgttatttgtggtaaaaaaatacaaagaatcacaattgtatattgtataatgcaagtgaaaatatataggggcaaaaaaattaattaattgcactttaaataaaaaattatgaaaataatgtagtttccaaagtatatacaaatgtatagcagtcaatcacgtcccaggcagacgtgttcaaacacgtccacacaggacgtgacccagcaccaatcacgtccatacaagaagtgactcaggaggtgacgacacgtgtcattttgagacacgtgtcattttgcggcgcgatgcataaaaacttcggaaggtcataacttttgactggaatgtccgatcgaggcgaaactggtggtcacgcactcaaaatcgagacgagaagccgctagcaagtcgcaaaggagatttgctcaaaatttttcccaaaagaggcctctaagtacctcaaaattgtgattttatcttcgatgacccaaaaaatttcttgttttctatttttcttttattcaattattgaattacatgctattttttatttttctaattacttctcttatttttgagcattttgacataaaatccgcttccatcggacatttctatcaaaatttatgattattcgaagtttatatgcatcaccaattttaccgtataattttgttcaactgttgaaagtagtgttgcgactacaatattgtcattttttaatttgttaaaccgaaatcatttaaaaatctacaatataattttggtaaataaatataccaaaaaaatagtagggtgtgataggaatgtccgttggaggcggattttgtgtcagaatgctcgaaaataagagaagtaattagacaaataaaaaatatcatgcaattcaataattgaataaaaaaaattagaaaacaagaaatttttttgtcatcgaagataaaatcgcaattttgaggcacctagaggcctcttttgggaataaattttgagcaagttttcgagcgcgtggccaccagtttcgcctcgatcgaacattccagtcaaaagttatgaccttccgaagtttttatgcatcgcgcctcaaaatgacacgtatcgccacctcttaagtcacgtcctgtatggatgtgattggtgctgggtcatgtcctgtgtggacgtgtttgaacacgtctgcttgggacgtgattaactgctatacatttataatactttggaaactatactatttttgtaattttttatttaaattgcaattaattaatttttttgccaaaatataggtttaaatatgttttttatttctaatatatatcctaattttgtcttttattcctgataaattttatcttcgaatatgtattttttttttcttttgtaacttaagtgataatgttatcagttatctaaaataaaacttttaaatataaaaaataatatgaaattttttattaggaatcaaatacagataaatattaagaataaaaaatatatttaaactaatatatatacaatagaattatgcatataatatacgacgaaattttattttcgtgaatatagaaattttggaaataaaaaagaaattactcacgtgtagtttaaatagtactgtgattatgacagtgaaaataatattttccctctaaattgattttaaaatcaatttagctattgtgacaagcagtggtttctttttctccaacccagttaaacattcactagatagctcctttgcagctcgtttagtactagatttgtagaatgaaattccaggaagtaattctctgtggctctatccccaattacgtgacattcaaattcaatgaaaaatgaagaggctgcttatgagttgcggctattctattctgtctctccaattcatcatgctttgaaatcaagcatttaccttcagtgagatactgcatttccagaacagacattttgattactctccacagaaaagatttatatgagattgtcagcaagttctatttcaccaggaactttggaaggatgatgaattgatgacattaaaataagcaaagatacgagaagattaaactgtaaagttccgaatggaatgtccaagcttctaagatttctccaacttaatacatattctgatgcagctttaagaaattcctttaagtgtaatgttcagcagctgtttacagggaatgctgtttatactgttatgctgctaattacagtttgtttataacgattagaggaatggaaaatctaggaccttgaattttagagttaatagctgatcttagtccgtaattgttgaagttgcacagcaaaggctggttatgaatgcaagttagaagcgatatgctattgtgggaaaaatattctgttaaggtttaaaaaacatgtttactttcgtttaattggccgagtccttactttcgtttttgtcttggcttttttagtatatgatagtaaacagtaatgtaatcttcaagcgatttgtttctggttactttgggccttcctgcgtagtttatataatgtaagtgatatctaaattattagaaattagttctaagttactgaaagcaataaatcaattgttcccgtgaacccagttgtaatactactcaattgaatactagattggacatttaatcatctgattagcttctaatgtatttttttataaaaaaaaattaccgtaaagttttctatagtgaatagtatattaacaccttttctgctgaaaagtgttatttttataattgaaagtcaatgaaattaatgtttctatgcataaatatcactaaaatggatttttttatctttttctcaacaaagtcttttttaaatacacaattagggaatcaaatgtctatcaatatgcttatggaacataggtatctactaactgggttggatcttcttggtcatattaacaccttagagaaatggtatcaatgcttgtcatcagttgttccatagaagatgaagataagcataaagcaacagttaaccgtggttgcatatacatgtacatttggcttctccgaactatgcgttgtcatgcataggctataactagataagcaagattctaattgttgtgcatgtctacaacgtgtcatgtaaactgttatcctctctgctcagaagtcacaagtaataacaaacaagcctacacagacaaacaccctggtccctgacattaatttcaaacgcaaaacagcaaggcaggtccataaggggtggtttggtaatagataaagggtttcattatattttatgattttttttaattcagagatcatgggtgattctcaatctactagattataaactaattctattcgtgatacatgattgtgacttgatccaaagaattttaatagggtgtaaaccgaacatgaattctcttattaaataaatttttttcatacatataaacgcaactaagtcttacattattatgtccatcatttgaattattaaattttatgaatttattagaatgttctgacaatgcaaatttttatataatattatttattacatattattatatattgtaagtatatacatgaaattatttttaattagttacctatctaaaaatctaaagagggttattgcatgaaaattaaactcattttatttgcgtgcagaatgctacctaagatcttattcaacgaagtagttccttggctctagccaatttaactaaaataattcgcggctcaaacgcaacacgacacatttctggtcgaacactacaaaccttctccaggtctctgatattttggcacaaaacttcactgtctcaaattaaacctttcggctttcatgtgttcaatcgatttaccatggtaatttcttgttatctactgagtaattattttagtgggtcctcctggggttcagatgacacatgccagcgtaaaatttactatatgtactaatttattcttaagaaaatatatgagaaactgaaatttacgtatgctgatcatgaaaactgtatcctacaaagctgtacataacttcttgctttttttttttttttaatacttaaagcatgtacgtaacttatataaagtgcaatttccacgcacttactaattacgtgtgtatctttaacttaatttttagggtgaatcttggccctatgttatctctgagccaagagttacaaagattaactccttgtcatagatattaagagattaattaacttttcttaacaaatatttttttttatacacatgcatattttaagtaattatcacatatttaaatgataaagttatttgttagttatgtcacactatgatgatgtattttactcaccaaactaacaacaaaatggtaataacttatggtatcaaaattgaagtcagttaatcttttaaagcatattctaaattctaatgagttggcttaattattgttcttcatactttagtttttacttgagtttggaactgttttgttatattttaggtcaaaattcttgaaattatgtcttatcatatcttattccttaatcctagggataaagtatgataagatataatcaagatatgattgagatttgttatagatgttcaagatatgataatatataataagatataagatgataagataaaataaaatgtttgatcttttagttatttagtgtcaaaatataactatttataatttgcctacttgtaaagataattttaattgaacatgttatttttatcgattttttagactattttgatatatatatcacagtttttttaaaagaaatatggttgtcggttattttatatatgaaaggaagaaaaaatagattattcaaatttgtgcctgattaataaaataaattgtgaatgatttctaagagaattatttaataaaactgaaaaaaaattaagattaacatgatacacaaaaagggttatcttcatgcaattattattatttttttaaagaaaattgaacctaatcaactagccatcattcttaattaattacttagctaatgatatgtttgaatacacaattctacatttattagaccaaatccctgaacagcagactagctaatatatatgcctatgtggtttagctagcctgttcagagattggtctaacaaatgtagagatgtgtacttagcatatcattaactaagtaattatatatatatatatatatatatatatattatattataccgtacgatcggttaaattcaatgagcttgatgttatataagaacagctatcttccatggtgtgacatattcagctttcatagagtttttatttgatacgtttttctctcctcattctagagccttcatcttgttcaggtggcaaaaaatgtcttcatcttccctctccataactccattaatcttcgattcaaatgcttttgcattctcatatcgatccctttctttcctctgttggccctttatattcttacggtccctcaattagatcttccatattattaatttgttctttaattcctatatatatcaaggatcatgcataggtgtacagaaggagagaagctttaattggtgaggctgatttgggaagaagaaagacaaggatcagtatatatggaggtgaattattcatgcttaattgttaactcccgttgatgagatatacagcatcatgtactaataatctttgtgcacatcaccccccacaccccatctcatttctaaagaatatagtatatatacaagtacactagctcattcaataatatatttctaatcagcatcatagatatctatttcttacattaagagaagcctagctacatgtcccccctcctaatatatccttttgcaaatataagacctaagatctaaaatcgattgatattttgaaggatttaatatatagatgacagcatatataaaagtaaaacatgaattaaattttagagatcaagtaattttctgaaaaactcactgccacttgattgtgatctacatattcttgaagttatttagtattattttctcagttttagggctattatttcccaggattagggctagggccattttctcagttttagtattatttcaaacttgactaattatgtgttaaaaggaattagtttcacatcttaactaaaagttgtagagatatataaaagaagacgaagatttaagtaaaattaattttgtttagatataaactacataattaacatatgattggtagaaaaacatgtctctttcgtttgtacgtatacacatgaattcaatatcaatatatatatatatatatatatatatatatatgtacacatatatataagttaatatcttaaataaattttaatacttcaaaatattagtcttggattttcagttagaggatacttaagatttgtaataaaacttacttgatgtaatttaattaattataaatataatatacatatttagaccaagaatagagtagggaaaaggaaaggaatagaaatatgcttgttttgatacacgaaaggtccacatgccatataattattatatatgtatggtctgattcaaatgcatgcatgatggtgttattgttcataatggacagggtgatcttgatcacgagtggaaatgcatgtcttgaagggttctattggtggttaggaatggactgtgatgagtgatgtgagatatctcatgttgacagaagagagagagcacaacccgggaatggctaaaggagtctttgcctttgttgggagtgtgctctctcttcctctgtcatcatcacattcacatgcctttgctttctagccaaactagacgtgtacatgcagcgtactgccttataccatttaaggtatgtgaagcttttctttgcctcaggttggattggttataaataatgtcgttttcaaaaatattgaaatggtatgtcaaatacgatggacatgagaatggataaattgtaatgttccttgacatcactgtaatacatgcatgatgtttttcttcaaaaaataaaataaatcagaattcaaattaaagaaaagggaaataaaagtggataagaaactctattttatattcgttgaattttaccataattatagtaaaaataatatcaagaatattcttagagttcaatggtaatctactaatagggataaaaataaaataggttatactagattttatataaataattaagtctgacctttttaaaagtttaatctatcttattagtctatttaaaagtatactaacaagataaattttaaataagctaacaaacctatatttaaatatgtcgagttaaacatataattgctattaaaacttagtttttaaaacagacaaaaaaagaaaacgaatgtaacatacaatagaaaaagtactaacataaaaggctaacttaaaagacatatgataaagaaaaaaagctaatctaaaaacatgggaaactaatgtagaacgataaaagccatatgattcaacaaggccgtgaaactattagtaacttacagattatattgtcagtcatagcctaattattatttattttgatatattaaataatatgacctttggttttattgatttatttaattaataatgttattattagtattatatatatatatattatagataaatagacaaggcctaataattattttttacaagcctaactttagcctatttaagtaaataggtctttttaaaagtacaagtctaacatttttattaattattaagtaagtcaggtcaagtcatattctcactcacaactgtaaaataattttacattaattatataatcataaattatcatatatgataattatgttgacttttataataaatatattaaaattcatataaaaaataattttttattagatataaaattaatttacactattcatacatcacccttaatctcatatttgtattggttgatatagtaataatgtaaaaaaaaatttacattaatattatatatatatatatatatatatattaaactcaattttcataacatatagaactgtcctacataaaagtcataactgataattgattttaaactatactactatatacgtattccatgaattgtagttttctgctgttaaaatttgggagaaaatggtgaccaaagaacatttctcaatacaaaatgcagagttcaagatagaaataaataatgcctcagcggcttcccctttcctttcctagttatttccaagaacaatttttgtaatggggaaaaattaggaacacattcagtaataaaaaattgtttacttactcattttcctttgtcaatacactgataatttgttgcgaatcgtctgagagaaatgattgtgatgatttgtgaatatatacgcgcggtggcatgatgaaaatgtgagaatccaaatcatcaaccaacaaaggagccattttctttttgggatacaagagccaatttggattctacaattaattaaggcgaatatttgtcaaaatattattttattggaacctttttatatttagttggtctgcgggaatttaatggcatgctgatatttcatatttcagctagctcagctcagaaaatgacctcttactttcgatcttttcatttctttttgttttggtggtgttgcttcttgtcaaatttctagttttgtatataacacgcttttaatgagcacgcttatgcaccaccataatgggtaggaaaaccagtacatagttacatacatggatataaaactaaagcagacagtggcttttgtctcttgattaaatgattcaaggttttaaatcttaattaattttaaagtttgaaataaattgtttgtgttaaaaaaaaaaaatattcactattatatattttggatatgaaagattaagatatacacaggtgcaaatagaacgtgagttagaagattaagttgtacatgagctaataggatgtgacagcatttacatttggttgttccaaattatataaacgcattggcatgcatattggacaataaccgaaatgagtaagatatcgattgttacggcatgtctacaacgtgtcaagggaaatttgctttcctcacaagtcacaaagttagaacaaatgaagcctacagagcaaaaatcaaactgaaacgccaaaactgcatggcattgccaggtccacagcggtgacgatggttcttgttgggagagttttaacttattactaggagtgtggatccggtgttttacgtgacagaaaaggggaaaaagaagaaaagaaaagagaaaaagcaaaatgttaaaaaatgaaaaaaaaaagaaggtaaaactgtcaacttatgacatatgatgacaatagtataatttttatatagatatagattaaaattatatttgaatatttaacaaaatatttaagttagtttgtaattttttttattagttgaaaaatttgtttgattttttgataaacaaatttttataagtagtttctaatatttttttaaaattattttaagtaatatttttaaaagatctagcttataattttttatatttttatttttaatatatttatctaatttcttaattataatttttaaataaattataattttattattttttattatttaacacttttcaactaattcattagttaattttatcgaatacttaaaatttagtaacctaatttttcagtttgtgattacagttaattttcagctaattttgaattttgttaaacataacctaaagttgaaaactcattagaaaaatcaacatttgaattaattttgtaactatggaagtatgtttgcacaaaatagccaagcaaaatgcgagaaggacaacggatacaattgagcgtttctacagaggtacatcgaaacttgtaattgtgacagcgaagaacagtagcaattcaaattatattcatatgtataaactgacaaaaaaattattgtaacgtcagtctgccacctactaaatcaatttcttttagaggtgagaaagagaaatgtatataaaaaaaatagtgaagctttttaaagaaactaaaggagttaataaagagattcattccatggggagaaattcaaagtagcacccttaattgctttgtttttttttgctgggtacaatcttaattgcttaatacatagtttttattttactttctccttttaaaaaatacatagttttattttcttgttattactaattctaacatctttagccttcaaccctttttgatggtttgttcaattaccatgactttccgttccttgagactggtataaacttgtggtcaaaagccttttgcttctgcttcttggacacaacgttaacatgggtgtgatatcatgacattaggctttatattgaagtcccttataaaatgatccgttcttgcatctgatacttgttgaacttgaacaaggtctttaattgcttcaggcataggttggtcattcatcattttcttccaataatcccccaggtcttttcttgcatggcttaagttgatgttggcaacctattagtagagataacattgaaaagtcataaaccatgcatctcatgacaaactcaatgtttcaaatttatgagttgcttcagaaaagcttaccaggagaagagacaagattgcgaacaacgcagagattggcttcatttctttgctaagatcgatgtgtgctcctccttatagcatgattaagattaattatgctctagctaccttcacaacataacatttttcttttagtacttgtcatccgagactaaaacggactaaaaatgtatatgtaggaaataagttaaaaagtatacgtgcaatgattaaaatataaagattgtgcaaatatatggaataaatgagtaattaaataaaaatagagtagattacagttaaactccctacttcaggttttggtgagattgtacaaactcccctcttttggaacgtttacatcaatccttgattgggatgatgtacatgtaatgtttttgaaagtgtaacttttacaatggtatgcaaggctttaacatgctctttgcctctttcccctacttctccgtgagtatctattgcgatttacttttgtttcagtgaagaaaacaattccatattatttgtattgaaaattaagttgtctggcaaattataccattaagtttgacacagaatgagaccaaggcccgtattattaataggggctctgattaaaaattctgaaatgaaacattacagcatgattgctaattattgctgaagtcataagcctttgaacaaaacccgatcagcctaatcctacttggtagtagtagtaatatacaaacatctatgtcaattttctactttcctcattctgtacaaacaccatgagaatgagagcacctaaaacacggttttacttattagaactatgaccaaaacaaaacaacaaaataagcttcgtctattgcgctttgaacatacatagcttattagccacatgaaattcagtgtattagctctgtgaatgaactatcactatgtaggatatgactcgttagtttttgagactacagaatagcagagtatagcattagaaatgatcaccggaaacaattaaagaatgaaaagaataagttgagttgatcagtcaattttgatctcgcacatagagtcttgatcagcctctgaaacaatgtcctcaatagtgagaggcagaggtaggtcagaagagaaggtgagtgttggcttcacttttggcacaacaagtggtgcagcctcattgtttagaatttgcagcactctcctcatggaaggtctctcagcactatcaggattagcacaactcaaccccaaaagcaacaatttcctcatctcttcctcctcaaactccccattcaaccttttatcagctgcctcaatcacttttccttcagagtgaagcccccaaacccaatcaatcagattcaacatcttagacccttctctttcaattggcctcctcccacaagccacctcaagcacaaccaccccatagctgaaaacgtcagtcttatcagtggcttttccatactgaagatactcaggtgcaaggtaccccattgttccagcagttaaagtggacacagggctcttatcatgatccataagctttgccaatccaaaatcccctaatctagggttgaagtttccatccagcaatatgttcccagccttaatatccctatgaatcactctctgctcacactcttggtgaaggtaaaccagcacagaagccaaccctagtgcaatgttttgcctgtgagaccaactcaaaagcttccccctttcaggttccttgtaaagcatcttgtccaagcttccattgggcatgaagtcatacacaagcagcaactcccccttctcaacgcaccaaccttgaagttgaaccaaattcttgtgcctcaaaccagcaatggtgttgagttcagccagaaactcagtcttcccttcgtgagaatgtcttgaccttttcacagcagcgatggttccagaagatataaagaaagccttaaacactgttccgaaagatccatgcccaacaatcctactaggatgaaactctcttgtagcagacttcaactctttgtaatgaaactccctaggataagccacgaaaccactcttctgaaacttgtctttctgtctatcttttctcccaccattcttccatctccgaacaaaaacgaaccccaagaatattgtgaaagccacaaagaaagaaacagaacccgcaacaatgccaacaaccctcttgtcacgcttcttcgtggcaccagaacgtgaaattcccaccacggaaacattatgagggtggtgcaacgtggtggtgattgtttctgtgtgaaaggtccaatttttgatatggtgaagctcggtgcttccctgagtggaagcggagaagccaacatagacggggtctctgaggtaatgagaaagatcgaacttgacagagaggaggggtaggaggggttttgaagaacgtgaatagctcaagaaaacgttcagtaatgtgtattgggtgttgtagtctatccatgcagcgatggtgttgccgctcttgaggtcgatgccctcaaagatggggtctccggttacgagggacttcaaggagtccacgtcgaagcccacgtggttctcgttcgggtcgtcaaagcgcgcgtcgaggcgcgtgtcgaattcgacggcgacgaagctggcggaggttgggaggccgagagggccagagagggtggtgttgggggagaggaagaaggcgaggccgtcgccggaggaggtggggttgaggttgttgatggagaaggagaaggtggtggagaaggaggcgtggaagagggagataggttggctgtagacgacggcgccggtgctggaggtgggggcggcgttggtgagtcttacggcgccgttgtttctgagagaggaatcgccgaggagggtgatgttgttgagagtgaaagaaggaaagtcgaagctcacgttgtctgctactgccacctcccacgagaacaacaataacaacgtcaagatgaagaagaagaaagtgaaatccatggccatgaactacgtggctccaagaatcaacaagaaaatgaatggagaagagaagtggatgttgtgtgtactgcatgtggaggctaggtatctttattttgcatttttttagcactatgtctatgtgcattatcaacttagttttttatcctaaaaaaaattgactttataatattaaggtatacgctattatcatctcttcagtgaacgatatacattattcataaagacattttccataataacaatcatacatcaaccaaagtagtcattgtaatatgaatgaatgaggtagacttgaattaaaaaataatcgacacttaaatgagagaaactattgtcaaaaattttactttgtaattaaggtgtataatatatgaaattagtgataaatatactttaaaatgcaatgtcacatgaagaaaaagaatatattatataataatgatgaaaatgcagtattatataatgaatatatagtgaaaatagttttaaaattaaggtttaatgatatgatgaaaataagattaacaaacatagctattagataaatgtttatcatcttttatttcatttcttgtttaccattttgattcttaaatgatattttattaaaaatatatatgtattttggaagtatatctcccaaactatggattagagttccaaaaatatatttctgaaataaatatatgtaattctgaaaagtaaaagggatgtacatctttaagaaaaagggtataatgaataattgagaggaggggtacaggggtgtacttggataaaatgagtgtaaatagcaagagcctaaagttcctagtattgttgggccacctttttgaatggaccctttcaatgttgcgtgaagtatggtatgggcatggagtattggaatttgacgtcttcgtgttcaacgcactggttctcatcaagtgtatataactatatatttgtatgtgtagtattcttttcatttcattcatcgtcttatttggcactccccatcctcggcttctgcttctgcttcgtggagcaccctcaatccgtcacccaacacacccatgtaaggttctcttttctgtaatttaattcactacaatgtctttttagaatcacagcagaaattaaaaatttgtctgaaacctgtttatgctttttgttggcaaataataggtactaatttggaatttattagaaaggaagacatggttgggattcatgtttgtaatttgagcttgaaactctatctcttcgtgcttaacttatttggagcttgtaactggaattccaagttcaattaatccatcaaggaaaaaaaacaagttattttgcatttggatttcagcattgcttgtttttaatggtttcaggtcatggatgttccattgccactggataaattggctttagatttgattaataatgaaccctcccctgcaaacacgagcaagtatgttcctgtctgtattatttatttatttatttattttgtgagggacttttcttttgaccttattattaattaattatgacattctttttctgtctctcattaaaacagcagcaagatatatgtaattctggtagcaactggaagctttaatccacctactttcatgcatttacgcatgtttggtcagttgcgtttccttaagtttacagtgcagagacttgttattctactgccctgagacatctatacttttttggtgcttataaaactcaaatctgaataattttaactccttcccctcctctaacaaaaataaatgacatcttgaatataagttcattcttgaaggtattgattattgaacaatttgacacttttctatttttccattcagtgtagaagaattaaggggaaaaaaattaagatctcatatacatcatgtgaaaaaaaataaaagtcaatggttgctcaatagtgtagtagccaaaactgcatgcatgataatcactttaccatttacagtggttttttgcattttgtgatcaaaccatatgttaacaattgttaaaatatactcactataaattatataataatataggcttctttgtctacttgaattaatattataattataaaatccatatacatataattgaatttgttattgaaaattctatgctgtacttactacatagatgttcaaaagagttgggtttgcctgggaacaattcataccagtgtatcttcttgtattgttagcttccttgagtcatgatctctgagtttctactttcttaatgaaggtgaatgggagtatatgttgaatattccctctaattcacttacttcttgatggaatttcattaacttaatttcttgaattatgtgcaatttaatttttaatttcatttattctctgctagtctgatttttttaaaataaaatttgtgggtgttacccttagagcttgcaagagatgcgttgaattcagatggctactgcgtaattggaggttacttgtctcctgtgaatgatgcatacaagaaaaaggtatgaagttgtcaagcaaagagagaaaaagattcttcatttattatatccatacatgcgagtctgtaaaacttgctagcaaaataaatgaataaataaggtaaatcatatgcttggcatgtggaaaacactgaaacacttgactgagtttttattttacttttttcagcaaatagatcaaatatgattctatgaatgaaattatgatttttattaatcaagtgatgctattagtttcactgccacatgttggtctaattgtattttgcttgcttgcatgtttatatagggcctaatatctgctgaacatcgaatacaattatgtcatttagcctgcaaaagttcagattttataatggttgattcatgggaggtaattactctttctatcagctaaattgcatgtcttcctattttctgtgcatgttaataagtttcattatccatagatttgaatttgagagacaatgctttgatgtcatgcgtgttgtgagaaatatttggctctctagctaacctgatttattaatattttgcatttttatccggctataaactgctgcaggcaagtcagagcacatatcaacgcactttaactgttctctccagagtccagaattcagtttgtgagacagggttggtatctagaggtatgctcaacaaacaagccttcaatgaaatcacattactctaattgccatttcaaattgctcccctgccccatcttaaaattcaaaataaaggaagaagtgacactgacaccagctgtcttaatctcttttaagaatgaaatactagtcacattaatggtaatccgtactgctgctgaactttttaaaaaaatgtggtgctaagtgttaggaatactttgtgatttaaatgattaatatatggattttaatgtttggacatgttttcctgtctctggcattaggtggtcatttgactctagtattttgtgggaatttcttagtgctatatggatgcatgattggatgggcaatttggttccatatggtgctaaagccttcaaaagttatctattatctatcttttatatatatatatatatatatatatatatatatatgttcattgacttaaatgtgttttagtgtaaaaggagcattaatagttccctcccttcattaattaaaaatgccgtgctagattttcatttctttctatgcatgtttttgacaatgttgtaacaatgcaataattttcttttgtattgatttgtgtagaatccctcaaggtcattcttctctgtggttctgatctccttcattcttttagcattcctggattctggattcctgaccaggtactataacggaaaaatcgaatattatttatcatagattagtttcacatggagttatttaatgattcttggaacaaaataccttgtcccacctaataaatttgataaaccaaccttaaatggttgtggaattcaaagtcagaggaattatgttgattttgtgtttttattgttagaattaacaagcttattgagtcaattattcttatttcttaccacatagatacaaggcatgggtggagtatagattaggagtgtcaaactaatgaattgcataatttttttgaattgaatccatttatggtccattaattatgtattacaaaaatttaattcatccataacttatttcattaaaaaaaggtccatccattatattttatttttttcaaaacaatatttttctaaaacaaagtttaatatttgtacacattcttacacccaaataccatagaatccaatatttgtctcataaagacctatgtccaagtaatgaacttggaactacttgattcactggattgcaaaatatgttggatggttcattatctatccaataacaaattggtaatccaattcaactaatgtattaagttttatttttataattgaatagattgattggttgatttatacttgatggattggacggttagtggataaaacgattgaattgccacatatgttaatgaatactaatttgccataggttgtggaaacaatgaactataattttgtttttgtacttaaggttaaaactatatgcaaagattatggagtagcctgcattcgcagggaaggacaagatgttgagaagactatatctaaagatgaaattctgaatgagaataaggtatctcacatttcaagcttgtcctatttccccatatgcgtttaaaatgaagtgttgcttatggacattttcaaatatctgtttactgtgtatttgtattttaccgaattaaggtcaaattatagaccaacttatgaaatccttctgtgatgtcccatatacttaggtgtgttgatgttcgatcaacacgggaattttaaatttaatgattaaaatttattatctttttgtttgtacatgtatgtgctagcgcacatcgttttttgttgctgtgattggttagaattgattaattcctctcaaccttgattactgattagctgttaaccttggacactttttcttgaggtgtcggagtgtgagacatgtgctgcagtaacacccaccttcttgacattttgttagacatgtgtcggatactacttaataagtgtatactggaccttgctgtatgacttggatacttgaaccatgataccttcaaagtatggatggatacttcaaggacactagtactatataaactataatatatatatatatatatatatatattcaaatattcagttatgaaacaaaattcctgggaccagagtttgtattagcgttttgttatgtaatgaacaataagaattagaatgcattgctttgctactcagcttttatacatatttaaattttccactatttttttaggataatatcaaagttgtgaatgaacttgttccaaatcaaatcagctcaaccagagtaaggtaatgctatgacattgtttactttcaagagttacaggacgataatttttaaaaaagagagacgttcaattttcttgtctttttcactaatctcagggattgcattgcaagaggactatctataaaataccttactgcggatgaagtgattgattatatcagggagcaacaattatacttgaacttaaatgataaatgattactactgtttttcattacattctgtagacatgggtctttgcaagagccactgcgcatcgctatctgagccaattttctataaacagatgatttttcatttttgtgttgtaaatttgctgataaataaatatcacataatttatgtaatcgaattgcaaatactactgttgaagttgctcattttaacttttttggataacaagtgagtgaaaaagtcttgcaatatagataggaattgataaattgagcaatacttaaagtgcgaagaacacttatacctaatgcctttaagactgagttagatgtagtatgttaagtttatttgttaacggttgatggggatctctgcaatatgtttgttctaaaaaaataaaaattgagccagggatattcttgattgaagccctgatttattgaaatttattcaagtagttggttgttctcaatagaaaatttgttagtataggcttaaactagtttttatcccgtggtgatgttataaggtagtaaaatttagtgtcattgttggttttaaggtagtaaaatttattaaataatgaagtgtcaacacagatttgatgttaatttaaaaaaaattaaactctagctaaataatattatataatcaattactgagcacactatattttacattcagtcaacttgatataggggcacgaaaaagagaccccatacttaatatattaattgttccatacattttaagacaactttaaatatgacaaaacaacacacgttttttttaacacaataacagaaaagctaaaaacaaaatgtataaaagagcatgttgtagcacgcctcctatatattgaaccacactaaatgcatttcttggatcgttgttgtacttctgccacgattaaagtaagcaacatgatgatcatagcaaacattggcactgctactagaaccaccaccaccacttgacacatcaccataaaacccacccatcattgttcccattgttgggtttcgaactattggagggatcactgggaaaacaccaacaaaaaaattttcttgcggcacagcataatttatatttgcaatagttggcagtgtagaaagggacgccgcacgatgtgggactccttatcaatatcatcaccttcatcactcttatagggagtattaatttaaaaatttaagagaatctcagtgtaatatgtttttaaacataaaacaaagtgttagtgtattaatttcaaatttaaaaagaatttgtacaagcaaataaaaactatatttaattatgtgtaatgataaaaatccagaaagtaatttgatcgtacatgactaatacaatttgtgataatcatattataataagaaagtcttagtcatgtatgtggagtgaaaacaggccagctcatgcccaatgagttagcactccggattgtctaagaaatattattcttttttctatttttcttttttaatttgaggacgttattcatctctcgctagttgccatatatatttataattctgaatttcagatgatagatttctttataaacaatcttgaaaactctttttatccaaccttgaaacgatgaaatctctcttgtgcacagtgcactgaagtctgcaaagtatttttttttttttttaagtctttaaaaagtatttcgataggcactttttcctctaaaagtatgacttgttattagttacaccaaccccatatgctcattgaaaggcatttataattcaaatatgcataattaaaaatctatccttaatattaacttgggggtatagcgttgccaaagatatacagtgatatatatagttttaaagcttacaaattacatatacgaatatgatgatcgatcgatctacatgaaattaacaacccttcatacttcaaactctgaacgtgaaacaccccttaagtcaagtcgaaacttgcgagttgtgaggcacgtattattgcactgtagacttatggtttaaatttaatttgacaatcaactttctgcctttcgaaaaagggaaaatcaaaatcttgttcatactgttgactacatccccacccagcattcaacaatatatgcgcaatcatatcctacctaagaatccccgtgtattccaattgtactatcaattataaagtattaaatagggagacatattaattttacaaactatactcactataatagtataattgaggtgatataaatttgatcgtacagtacggatgaattaattaatgatcacttaaagtaaactttttctagaaacacatgacaatttatggcatgtccgttgagaactcacacgagagctgcgcattccatggcctatatgcttgtggtcagatagttataatgaataatgacatattaacactttatgatttcaaagatttaattaatattcatttttctgttttatttctctttagcatcatatcacttataatacatatttatataaatttttttttatccatacgaattaaaaacataaaatttataataatttatgcattttagtcaaccaagtgagttaactcttttaacctatgtttatataatttcattttattttttagctatcagttagaatttgatgtttgcccaatatcatttttttgcattataaattgcaaccttgtaccaccacttcccaacttccattgattagttctaccccctatcctatgctttgaaactttagccttttgaatccctagctataattctatagttaaatcttcttgtgaagcttaacattcagttgagccaatgtcaatcttaccaagttcaggggaccgattgtgtgagggtgattttgagattctccctgccacaaatgatgcccatggaggagtcattgtagatttggagaagccaatggactctgaaattttcgttactctgcttagaacatcactttcaaaatggaagaaacaggtaacgatatcaatgcatacttcattaagattaaggtattcaacttcattaagattatggttcataaaataagatattaattcacgtgaaaattaagtgtaattactcgtcttgtaagtgtacaatttttcgttgtttataaaattcttaagcttcactgatccttaatttctttcaaccctttgtttggataagtcatctacagatcctgcgataggcttgagtgcatgttttcgcttcccgtgaaagccttagcctccagcaccgattgcttcagaatcacgtcactcagcaaattttatactaaccctgattttatataaaaataataattacttaattcatcatgacaaataaaaatagttagattaattgttttgtcataaattttaattttatttcaaaattatttataacattaaataatttaaaatatgattattttaaaataaaaaaatttcaatcaataaatgtgtcttattttgttgatataactcaattaaatacacacttttatggaaaaaagaaagtaatcattaaaaataaaaaataaatttaacaataaattaaagtagtctttatatctgttataattaagataaaaaaatattatcttttgttttatatatatatatatatatatatatagagagagagagagagagagagagagagagagagagaacatcataggtagtaatcgaggctagagataatgggagagacgagtgaatgaggaaaccacgtgtgaaaccatgaattattttatcattttttagatgctccatatatttgcaatcagaaacaagatgttatataatcaatattaggcttttcaatctcatcattttatttttcttcgattttgaaaaacagatcatgtaatatctgcatactataatcagcttactaagaaagactagttcagccggaaaatgtgaacaacttttaattcaagatagtatcaacatttatgaatttgaaaaaagtatactatccaaatgatttgtaaagaaaccataacattaatcctactatcttatcaattataatatacgttgcaggcaaaatgcggtgtttggatcaagttacctacagcattagttaatcttgttgaaactgcagttaaggtaatgtttcctgtttgtgtcagattttaattactttaaccttgtacaaggataaggtatatctattcagctacataagattgttttaattaaattatctaatttttaaatccagatggaaatgtttgtcagattctaatttcttttcttaaaaaaaaagtatatttttagaatgtgaatttggatctaactcaacctcaaaagctagttcaataagattaaattcttagaatatgagtttgagtctaactcaatcccaaaaactagcttaaaaaattaggattgttctcccttatatactctattttaattttatctttagtcgatatgagacttgattttttttcaatatatatatatatatatatatatatatatgcatatgagtttaatttaaacttgatcatgttagttttcactattaaataggaaattattggaaatttaatttaataatattattcagttttttcaattatttaatttaatttttgtaatttatattaaactgattcagttcatcatgaatactatcagtatcagaagacaattttatcgtgaaatcacaatggaaatgatcgaatggatgggatcgagctagagaaactattttcaatataaatgttatctcatttttgtcagatatataaatttttcaatgaatatatatgttggtggcatgatgcaggagggtttccggtaccaccatgctgaaccgaactatctaatgctagtttattggattattcctgaaacaagctgcacaatccctcccaatgcatcccaccgtgcgtgtaaggatcggtggtcttgtcttaaatgataacaaagaggttcgttcaaaatataacaacaatatataatatatggttgcctccttataattgattccttgtttgctttcaactagtaggtttcattttacaactttaattacttttcctctcttaattattttcttttcttttctttctttcttatggtgggcttatatataggtgcttgtagtccaggaaaaaaaagaggtacattccatgaaaaactggcctgtggaagatacctactggaatagttgaagcggtatgaacattttcaaccaaaaattcctccccacgtgttgaaaaataaatatttcaatttgtgtagaaacatgaaattaacatgataacttcagggtgaggagcttttagccgcagctgttagagaagtaaaagaagagacgggagtaagtgtcaatgtaaaatgttgctatgttgcattttatatttgttgttaattaaatgcgcgccctttcttatgttgtattaatataactcaactttgctatttactttccttgttcagattgatacagaatttgtggagttactggcattcaggtctcaattttcttcctcaaacttactttagaaactgaactaaatgtctgtctcctacccttttttcttcatcatgattttagcattagagaatgtaaatatataaattgtctttgccttcactgatgatagacatttacttctcataaaatctgcctttcttctttccctcttattttaattttgttttaagctgctcctcatgtttatgatttgtaggcacgcacataattcactatttgggaaatcagaactgtttttcctttgcatgttgcgtactctttctactgacatcaaaaagcaagatttggaaattgatgctgccaaggtatacagtctttcttttatttggtttggatgtaaagatgtcacaaatgatcaatgagctaactgattaactttacacactatattgccatatctgatcgagtcatgttttgcatgtctacatttaacaaagtttatcattaatttttatatatcaagtgacaaagtagtttttgttctcatcacccaacaaatgatagatattttgcaaggataagaccggatcacataagaagtgacatatatatgacaagacacataaatgaagcatccttctttaggactagctagtattaattgtctaacagatgagccaagcgacgcatatatatatatatatatatatatatatatatatatatatatatatttacacctaacattttaatgcgcatgctctctacaacaaattaaagttcaatggcaaacaaaaaatgactttcattctggtgcgtgaacgtgaagtttgtgtgacataatatgatagaaagttggattactctgctgaatatatatgattacacgccaaactgtgtttggttggattaagcattactagacattttaattgcgaccaaaatttttataaggattatatgaccactatccacatctgattattttgtccccacatttttagcccataaagcaacatataattatctcgtgcgtaggttcggatcgatcacgtcccttgcatagttggaaaatgaccatgcaactcataagaatgatgtggattcttgaattattaatacatgcacatacgatagagggttctatttgttggcaatttttctacatgtttaaggttacaattttttgagcctctccaaccatattaaattagatacgaatattctttcaaacatcctatcgacacattttatttttctttttttatcatatcataaactctataatatttatatttttcatttttctctcacctactaagtgtttaataacatttgaagtgttcatttatcttttttctaactatagttaatacggtaatacccttttctctaaagaatttaaatcatatatgctgactaattaactttacactgccatatctaagtgatgttttccgtactaatgtagtgctattgttggtaatcatcttgtaatttctatttctacggttttttttttttttttttaagaaaaaactatacaataatgagagataaggtggttaaagtgatagagagaaaagaaataaaagtataataaatgttatgtaaacttgttatataaataacttaacttttttatctgtatattattcaattcttttgacttcaattttcatgtatttcttccttttgtcacaaagtggatgccgtttgaggaatatgctgcccatcctattacagagatgcacgagcccttcaagtatgaaaatgaattatgcttagcaaagttagaaattaaggtgctatgctggattttctccacgacctatctcatcatatttataggagcaattgagttatctatatttaaatagccatgacttggacaagtcttccaattcagtcaacggtttgggtcttagacaaaagttgaatgatatctgtttctcacatttcagatgttaattagctgctcgttcttgtttcctggatttttcatgtttaggcacagacacggtgattatgccaattgatcacactagctaggcttcattttatttgatcgggtgcaactttagcattgcgtctaataaaccataatttctctgtttttgccctgtatttcttttaacaccacagattttacatttcgattaattagatgttgtgtaagttgtcgtgtcgaaatttgaacaattcctacacaaaaaataatcttatgactggtttgggggggggggggaatattttgtttatttggataaaaaaaaaatcaatgttttctcccgaaaattttgtcttcattttaattttttttcatctttcaatttccttttcttacaaacgaaccatagtgattttttgaagatggcagaaaaaatatagtaattttttgccccccaaatcttcattgttcaataaagaaaaatctctagttaaaagaagcatttacttgaaagaacttgttcagcttttagtgtcatcattgtactgaactccattatcagcgatagtgcaacatttatcaatgatgaaaaagataagttctaagaagaaaaaaaaaaacacctttaattaaagaaagagaaagtagaagtgaaaaggaaaggttgaaaattttaacaatccgttagcacagagactcatgcaaagaggaagacatttgtgtgttacttcaataatatcatgacagatgtgctgccatgcggcaccatctccctagtgtagaagaaaaggaggcgaatgatccaagactgcattaaaaacaggtgctggttgcaaatgaaaacatccaaatctagaacactcttttccttctaaagtctttttttcgagtatgattcattctgtgattttagaagatatgtctaggggagtcttcccaacagggactggagacaacgtctccaaaactttttttaaggtctaatgttgtttgacttgtgttttattatttatagtttggaattaggtccataaataactattatatttagtatttgtaagtctatatattttttataatttgagtgtaattatacaagtgtgtaacaaaatatagtgaataattgaatgtaatccacattgggtgaactggctaaattctgtgtgttattttctttttctcttttatctttttattttttctcgattattatgtgattgtttagtatccaacatttatgaggtcatcattgcaattcccattatctcccagctccacactcctttccttcttataaatgaattttctagtctgaagtaagtaaaacattaaagttgagagaaaaagaaatgtttggagcaaagtttgtggcagttgtagttgtaaccctctggttatcacagtccaattttaattttgaagcttatggggatgcagtaggtgatgtgatcccaaccccaacttcttgtgagaattgtcaggttactccaccaccttctggttatccttcttatgaagctccaccaccaccatcacagccagctcctccatcttctggctactctatatatggtgctccaccaccaccatcaccacacaagtcaggccaatctaagtgtcctcctgctgcaggtgttcagtgttgtacccctcctgcaccttacacttatggttatggttatggacctccaaatccttacacctatgtgccttatggggaaggtcaaggccctgcttctatggttctgccaattatagcccccctcatcatgcttttttcctcctttatttttctagtctgaatttgccttctttttgttgtttatcgtcgtataatatcctgttgtcaatactcaatagttataaatgcttttgtaatatattcatcttgtgtagctccatgtggtatataccatatcctctccaagttcaatatccattgttatatatagttaaattccctttatgaataccctctttttggtatgaatatgatagcaagaaatcttttttcttagcaagtttgtggctaatttagtatttgttttgggggaagggaaggcaattttatgaagttttgttatttattttgatttttaagaaagggagatggagagaacaaattctctcccccatctacttttagcttttctccaaaatttaactccaattcattagttcaaaattaaagttattttaaggaaaagctgattggaaacacagagcatataataaaattctcttattctacgcaacatttttgtttgtactattctcacaatgattgttgtcattgtattacctttgtcctcgttactagtgacatttacaatctgtcactactagttactactactatttgttatatcatcaccattactttatcgctaccatttgcataaatggtagcatacaattatcaatattgttagcattattactacaactaccatcagataaaataacctaaataataattttttaataattaattatcaatttggattgtttgaaaaataattatacatctgggatagttggtcacagatggagcgatgcgtatataaactcggacgatcataacttttgactggtttgtccgattgaagcgtaatttgtgtcaaaacgctcgaaattgagagtagaagccctaggcaaatcccacaagaattatacacatgaaatttgcttctaaagaatgggaacatgctattaataattttaataaacattttttgatagaaaataacattaaaaaataacgtttaatatatctttcaaatggtttaacttttgatagaaatgtccggtcgaggtgtacgatatgttaaaacgctcgaaattaagagaggtaattaaaaaaataaaaaatagcatgcaattaactgaccaaataattaaaagaatagaaaacaagaaaatttttagatgttcgaaaattaaatcataattttgaggcacttagaagcattttttgggaatttttttgaccaaaaccccttcgaaaatttgtctagggcttctactctcaatttcgagcgttttgacacaaactatgtctcaattggacattccagtcaaaagttatgaccgtccgaagtttatatacgcatcgctccatctgtgcatgacacgtgtcgccctaaagtggaacacgcccaaaattggacgtgaccacccctagtcacgcctagagctgggcgtgactggtcatgcccaattctgggcgtaaccaattaccccagatgtataattactttccaaacagtcccaaattgataattaattattaaaaaaatattatttatgttcttttcccaccatcatcattattacagttataattgcaatcaccattgtccccatcattattaacagatagtaacatatttgtcactattattaacactattactacaactatcattatttttactgcaataattgcaatcaccgttgtctccatcattattaacagagagtaacaacatatcaaattcggaaacgcggttaatccattgctctagcaaggtaaaacttttgggtggagaaaatctgcctaatgatcaaaacagctaactaacggttactgatccagattctagaaatggtttcagcctaatgctgcattccagtaattcaagcaggcatgtgatcatgtctaccaataggtaaacggcaaaaatgtgaagaggcattttaagatgaaatggttttgctttacagtcctcgtatcacaaaatttaggtaatttctttggcaacttcagagcccctgatacaaatctggcccagggcaagttgtcattctaagtatatgagaagaaataaataaaagcattacacatgagagagcctgtttttgaatgttatatgcagtgtatgattcttgaatccatgataccgcaacaaaatagcaattttttttagattgttcccgagtgacttatacagagtagttgataagggtccaacacctaagcattttctaagaacagcagacatgagtattgtaaagctaatcacagatactatagatgaggtcaagtaatagaacctctggaaacagctttgatgctgctgtttttttatcaacatcaacttggataggtagccggatacctatagatcccacttgagggacattttgataaataaggaaaggagtataacaacgaacaaatgaaatcccgattgctttttaaagtggatgctgagaccaaaggcaaaactattctaaaactaatcaatgcaacatttgagaacagaattggattggttggacacaaggcgaagctaacagatagcatattgacatcctgttatcctttgattttacactgaagttaccatggatatgtagtcatccttactataggttgtcaatcctcaggccctcctaaccttgggaagagacatggaactttacatccacatatcagagtttatgctccatgtaacacctcaagatgctaaatgaagattgattaaacatctccagaattatcctagtccaacaacctttaagcattgacgccatcttgtatctctcagaaaagcttgttgtatctattaaccaacttctgtcatacatatttcaagagtacttagtacttgcacattcaactgaggctcacactctatcacgactgctctacatgtgtttagaacttgtttggatatgcttctctaaaagcatttctaggagaaaaaaataagaaacaacaaatgaaaagagtttctccataaactaaaatgaactcttcgtagctaatttgtagatgtcctctcatcctttagaaaagctatttgagagaacttctacaaattagctaattgagagcacattttagctaatggagaagttcatctcattttcttatttttattttcttgtcttagaagtgcttttaaagaagctcacccaaacaagcctttaggatataaaggaaactagaaagacacgggggagagtaaaatctaaaattgtcacatagattatccttgatcaatcaaacatgctactaatcgagcagatgtgagaaagtaactaaacactttaagatctaatatagggatcttcctgcctcaatatttacttattttccctcgttcattaacaggccaaaataacaatttggttccaaagcttccagcaaaagaaaagaggaaaagattataacttcagcaaattacccctatatgtgtttcctacttccgctatgcataaccattatagaaaaacaccactctgaagtctgaactcttagaagaatagctcaaactaaaacctaacgacataagaactaagaagagaagataactgattgtaggattgttaaaacatacaagaaattaacatgtatgtgtggcacactacaactcaaaagccataaccattcagtaaatccagagagatataatattgaattcaattaacaatggagaaggggaagtttctcatcatcttacaataattcaatcctgatttagaaagacatactagaatccagcaatgtaagaaacaactaaaatccgttttgcagaaactttccaagatagttaactattaaggaagtgaaaatgcaaacttttccactacttaggctgaagttgctttgctatacaattaaattatctcaataacggattggtgattcaaagaacttgcctatcagctgcctcagcaacaatgggtaatctggggatttgacccagcaagcaagaagaagaaccataaatcaagcacaccaagaggaacaaaaacacagtgctatccaaagtcattatcaaatccaatcccaacccatccttgggattaaaccctctttcaaggaggtcagggaaaatcaagagcacatcaaggacaacggcttgcatagtgttgaacctcacatacttactgaaattggggtttctcaccacaacaaaataaagggtcaaaaacacaaggaatccattaaaagggaagctcttgaaaactcttattgcaggaaccaatggttgaacaatggcttgaacagggtagaactgtgtgattacatactttccgtactgtatgccatcaaagaaagggtaaaagtagcaaagtgctgaaattaaacggtcaggaacatcagcagagtcactgccattggatttggccactatgagggttctcagttggtggggttttctcaatttctttggaagaatgtttagagtgagaagagaggggggatgcagaaaagtggattgaagtggcttctgtgagaaggtaaatgctgcggggcagaggaaggaagaggaagccatgtttcaaacgaagattcgattttggatgctgtatgccaaatggggagagaatatgacgagggagaaagggcacgaggatagataacattacagtattacactctttcttctttcaacaaaaactaacaaaaaaaaatatcttattttcttaggtaaggaaagtttcatcaaaaaattatttttgttaaagattttattcaattattatctaacattcaatcttgattttaacacattaattacttatactttaattggttttggacataaaataattgaataacattaaatataaataatagaaaatggacaataaacctaaactttaaaataaacatgtattatttgttaaatagttttatatttttatatcttgtaagaatatatatttttcaaatatcattgattatttaaaaataataaataaattctctgaataaaaatatttttttatatgcaattattttaactactctgaaaatttcaactttttttttatattatataatgaacatacaactttttttaaaatgttgttgtgaataaattgaaataatctaagaataatagtttataaaatgacaaatgagaaaaaaaaaaagatatagatttaataatcaattctctaaacaaaatcaattattagagcagtaaaaaaatcagcaactagagttttacatgattccattgcgagatggtatagttgtgggctggcttggattgtatcaacaaacaagcctatatacaacagcttacattggatagccctgaccaaaacaaattaaaggcccaaagaaaaacaaagctccagatgaagtaaaagcacgagtccttcccccatcttttgtcagattttaatatgcatgtacagaaattgtaaattttttaacattattaattaatgaaaaatcattattcatataacttttaaaataattattataaaaatcaataaattttatggttctgtgcgttaaaatacaatgtcagtgcatactgcatatattatttattcattttgctataagatagaataaagaaatggtagtttatacagataacttcaaagaaactatcacggattatggattgaattttctctaacgttgaaatgatttaacatatatagataaatctctgtatcaaattactggttgtgagtggtatatatgttttttttgatgtatccactatccaggacatttgatggtttcaggtagagagcaccatgcatcgcttatattcttcgatgtgaatgtgtattggcagcacactgtcatcgcttatatcaatttcaatagttgctaatttcctataaaaaaaaaaaaaattacctttatcaatgagtaatttgaggaattgaagtcagcttattcagtggcaggattcgaattaataatacttgtagaaatgtttaataataacaaattaaggtgacgagtttgatcaattgcttcatttctgatgcatgcaatgaacaaattatatactttcttcgtgtatattagtcaactttctgatttatatccaagtgagtattcatacctttaacacaaaatcttaaaacttaagttttgtggatcttttctcacttgtatgttaaagaacttttccattattatctaatatgagattttgacgtcacacttaaattctaacacaactaataaaaaatgtttcatcattcatatattcagctagaaaacacttccaatcacatgtatattcagctagaaaaaggaatatttgacaatgtgcatgggatggacgtaaataataataacaataaataatatacatgtgatggtacaaaaagaaagaaaagaaacactgtactttttaaactttgcaaagtgcccaatgaccaatgaaagtaataaaatccatacttatttcttggtgtaataataataattaaggttgtaaaaaaattataaataatataattttatgcattttaataaataaaaaattcttttaattccttaaaaaatgtcctaacgctatcgaaactcattagcatttttccaataataatgatagaataatttctttccctttctttcacttcacttcagcccccgaaattagtctctgagtcccagtggcaagcaagcactaaagagtaggagtgagtcatgcgttattatgattttaaaaaataataaaaggagcggcgaatagaggagcacgtcgatggtatgtatctgactatctgggtctacaaggcccaggcccaggcccaggcccaggcccaggcttacccataacaggaaaggcagcaggaggcacttgacgatggtggtaagcaggggagccgtatacgtgtccctgataatgatgataggcggcggaggcggagtccttagagtcgcgggcggcgacgctcttctcgccttccatctcgcggaagcgctggaggtatatcttgagggggtcgccgtagtcttcgaagccgagggtggtcatggcccagagaaggtcgtcgccgttgatggtcttgcgcttctccctctggcacttgtcggaggcctcgccggttatgaagctgatgaactccgacacgcattcctgcaccgtctccttcgcgtccttcgagatctttgcgttcgccggcaatgccttcttcatgatcctactcacgttcgcgatcggcaggaacctgtccagttcccgaggcgacaactccccgctgaagctccccccctcgtttcccgcgttctgcgccccgcccgactcgttgtccgactcagccatcttcttaacttaaccaatcaattcaacactctgctctgcttttctgagttcggttgacttcagagttcgtgaaaatttgagttaagaatggactgagcagggtccgttggatcggctgcgttaataagcctttatctgcttcacacgtggaaccttcttggccgttgtttgtcgataagcacggacaagtttcccaccatgggattggatgtcggattaatcatctggaccgttcctttcgtatctgctacatgctctcctctcttctctcgtttattctctttcttccgtctaatattttaattatttagcaactttgttgttttatgcccacacatcttaaatataaggttcaagattcactggtttttggataaatttgagttacttgttattaacagtttaaaattaatttcagtatgatataaataaatgaacaatatgctgtgaataaggtaaatgtttcgtgtttgtaaaatacacacggacgcacccccaacttatactttttatttgtttgttggttttagtagtactcgaaatcttagattaaaataacagcgctatctcacttcaacggcgggttgcggcatccaatcgctacttttttatcataatgcgacggtttccagtagcggccagtgatggccgatggcagcgttgcgggtgacaaatcttgcagcgctatcgcgccgctacttccatggaagctccaaatatacaaaagtagggattttattattctttagtgccaaaaaatcaatgatgtcttcttgatggatgaatatatagagtgtttctatagaagaatgctccaacactttagttactagcaattccagcaagtaatggtaaaggaagggagattatatgtgcatgaaaattttattttgtcatttataatagtgatctattttgctggtgttattgtttcagtatctccttaatcactttattaccactgtaacaagggtacaatagaatcagaggtacggtggtccttataacagtagaataattttgttatgacctttctttgattcacttgggctattcaaggcaacttagggtctaattaaacacgaggtttgagattctgatctacaattacctcaacttgagcctgatatatttatatgttaggtttgggtttttattattttggagactttcaatagctgtgtttgcatgtcaaacaagttgcgattacttcattcatgatcttacttctatgttggccccgattttgtttaaagttattattttagttcttaaaaatcttaaacatctattttttaattcttgtttttatgtagtgtagacaattaaatggtttttttaatactaaataatattttataattttaattcttatttttatatttttaagaattaaaatggtgatcttttaatgaagttaaataattttaaatatgaaaaacttaattaaacaatacttgttatgtcaaaatctaattttgaatataatgtattactcttgttatgaatcttaatgcttgagttttatttatgaaaaaaaaaggtgtgattagatcatttagatgtgtcggtgttggccataccacggtgagtcttttgagttttaaggcctccttgtccggtgtccacatcacaaccaaacgctatcctttacattaactaatgttatgtaaaggatgtaaaaacaagtgagtttattaatattttgttctaattttagtttttatttttattttaatattgcataacttttatatgtattatttataattttaaaatttacttatttatgtgtttaattcttatgatgtatatttcttagctagtcgtaattacaatattctctaaccatttatagaattagacttcattttatttttgggtaaatagtgaaattcatcctccaaagtatgatgtagtaaaaattgatttgatgaaagatgaaaaatataaatttagtccatccatattttcccaagtggaaaaaaaaaggtgtattttaaagttatactagcttataacactcctagaatctagattttctaccacaaaattcgcgttatggatgtattggccgttctcgtaactgatgttcaatggaacgtttgcgaagtagtgacagttataataatatttacactccatgtcaataatctcttttgttgaatttaattaagctactaacagaaaaatatttacaattagtgatttataactacaatctaagttgttaatttattttatattttttttataatttacattatcaatcaaattgtgatttcaaaacacaatacaagacaagcatctgccaagtttatttgaatttgagactttagtcacttgatcactactatgaaatcacctccaatcattgcaaagcatctggagaggagtatattaaacaacaccaaaaatctggaaaggagtattgttagtagtaaattgttttaaacatactttttatcgtttattaaaatttattaaaaacaatcaaattatttcaaacatgtctaagcacttggacaaaagctaacaaacaaaatttatcgtttattaacattaatagtgttttctttctatctctcttttgtattgcattaattttcacataaaatgaattcaatctctctacacctcttttttagttttaacataattcattacactctaacaaatatttaggatacattttttaactacaaatattttactatttttcatgcaatgaacttaacattaggggtgtacacacatcaatttgaattgggtttgacgaaattgattatctaatccaatcaaattaattttggtcaattttccaagaaaaaaatttaaaacacaaatcaacccatttgtaaacggtttggattgggttgagtcaacaaggtcaaaacatataaatttatctattattttttaaattttaatatttttataagctaaaatttttattaaatggaataccgaatacattacttataattattacgtgtagttaaatactagaagaaaagacaaggaatggaagaaaagacaaggagaggaattacattattgtcatcatcatcacataggtcaacataattatgttaaatatagtttaaaaattgaaacataataaacaagttcaataatcacactcatgaagcctaaaaatacaaaaactatagttgttatatcatagttttaaaattttaatattctcaaatagttaaatgagtagtgcagctgaaattttaactaaatctaaaatagttttaatacaaaattaaaaataaaatagatgttctacaatcaactgagaattaaaaccttaattttgtgagagtgattgagtgaacttgtgaaaactaagaaaagataaataatctcacttttagttattatgtatgatataaatagtaattgattttttttaaatttaaataataataataataataacttaatacaaattaataagccaaatcaactagttcatatattaaaatttgtaactaacccaaaattcaacaaattaaaatggattgagtgaatttgacccaaacacaaaaaatccaaactatttgaattcatttaagtcaattcaaatatgcatatatctaatattcataaacatccctacttagtattattcatcttcaactagaagaaagttaaacttcccaaatatttaaaagaaatgtttatctacttatatctttttttaagataaggatacccttaaatgacaacctcgtaccacaaactgaatcaacaatcggctcataacttgcattaacgatgaagaagaaaacgttcccataatggcctccaaagtgatagtaatagttaattgttggtcatctaacttgtggtacaataggtcaaacaagaggtgcagaacaatgagttatatatttgtaaaaaaaaaaaaaaaaaaaaaaaaacaatgagttatatattcacatcacccacccacccacggacactctcatgcaataatttgaatcatttggagacataggcttttcaagtaagcaaatgggtgacactagtttagttatagtcagtggtcacatacacatatggtgactttgcatatatgcatccactaataaacatcaattattaggggtgctaagtgggtcacccacccttgcatcattggtttaatttctattattgatgtgatgtccaaaccttgtgtttgtttcgttttatttgttcaactctttttcttacgcatattttttttagggatacaaaaaactagaatatatcaaattcaattgagttttaaatgttttagctcgtgtgaagtcttcattatacgtccatatgtaatgtagtattttaaaagtaactcgtgtcatactatagacataattcgactctaaatatatagagtctgaaccttcaaacagatacaacgttcctttttttcattaaaaaaatattaagttaatgaatttaaaattagttctaaagtcaacaaatctactataatggaaatttattatgggataatagtatataaaatgcatatccttttttctcaaataaaaataaataaaaaatagctattgcattttttttatataatttaacattgaatagtgttattttttttaagacgctcatttaaattagaaaggattttttccacacaatatttttcttaattacgtgataagtaagaaaataatctctcaaaattagataagtattagaaacaaagtcaaatgacacaagttaaaaaattaaatactgaagatatttaaaccccttcaacctgcgttgatattccgaaagaaagggatgtttggataagagattaaatgctcgattgcatcctttctgtgtcttcttttctatatgtatatatttcagtcaagactcgagtcctttctggtttttctttccagtgagtcctttatggttgactgctgcagagtaagctcggcccttattttatgggtcagagaattattaagcccatgtaaacaacgggctaataacccataagtcctcttaggaccacgccactagtttaattgtttatgcataaattcctttttaataaaaaatgctatggattcatatttgtaaagctagaaaaacaatagctaggaaaaaaatttgtaacgacccttctttgaaaaaataaactatcaaattgctcgtcaaaattacctatttctctactcttaaaagaaaatttcttttaaattataatcaccaattattaaaaatagtaattgtcacccatggtcctaaaacctttagttcaaattttaagatagtaaattgtagatttcccaaatataatatatttgtccaactacttattaaaatcgagagtagtttggtaaatgatttaaaaataacagtatttgttaaagcactgttatttactttatggcaaaaaaagcctatattttgcaacttgtaacatgcaaagtgcacagcctgagtcagcagatacacttggcacatgattgcatagtaaataaagtttcccggatatgagagggaatgggagatttgaagagaaaaggaaaagaggaaaataataagacaaattgatgacaagcactcacaaaagttcctttgtgtatctaaattagggaaggaaataggtttaacatgcatagagtcaatcactttggtctgacccgtttaattaaaaaaaaaagatttaagttttaaaaaaaattcatttagttaaataggttagacgtgagtttataaaaaaatctattaaatctgatagattagcatactaatttatttatatataataaaaattaatatatgtgtattatgcttttatatttaatattttaataagttaataattttatgtcaaataaaataaatatttgagataaaagactttaagtaaactaatagatcatactaaactttttaaaaaagacaaatcaaacttaaaaaaaaaaaaagaaaaaaagtcgttgatagattattagatcaaactagaccttaatttttaataataaatcagacttatttatataaaatctgatatatattttcactcctaatctatagtcattcaaacaaaacataatcatactgtgttttttaatgttacgaaacagataaaattaggagatttgattgagatttgaactaactcttaattaaaaaaaacacggcttaagattaaaacgccaagttaatagaagagaacaaaattttggtaaacatcaagaaggaaaatagctaatgactaaaacctcacctaaaataacagctcaagataacaattagtaataaaagattaatcactaagaacacaatgatctaatctgcaaaccaactccttctccaatctcaaatcttgatactttgtggatcccttggaaatatcaatctcaattaaattttcgtcctcattcatctcattaatttctgccaagagctctgtgagaccttgctgcttgaaaatggattctggcaagaactctgaaaagtggttgtttggaagcttgatttcaatcaagccatcctcctccccatcaacatcataatcaaagaccaagctatcagatatatcaagattttgatttctgttgcgatgaatctcaatactttcttcatccatggttgagctagcagtgctttcactatctgatggaagtgaagtatctgactgtggatcagcttgttgctcatacttccgagcacttagttcaaaacttgtatccatgatattgcttctttcacaatctaatggaaatgaggactctgagtgtacttcagcttgcctctcagaagtttcattttgttggatagtaacatctcccaatgaaggctgtaactccaaattgggttggttatcttggacaagattttcatgtagggacccttttttctttgccagtgtgacaagaaacaaggtagatagaagagcaatcagtagtgtaagaagggaaggagaggattcagaaactgaaaagaaaaaggaaattgaaaatagaaggacaagaactagaatgattggtaagaaactggcaaaataacaacacagattgtgacagatttgttgctttgttactttcaccatgatcattcactagaatgaacttgttgtgtcaaagccaaagcaaatgcaaagatccaactcacccaacaaagactgcaagaagtactgttgaaaaggagaagaagatcactgggaaagactacaaagaagtggctgaaaatttgttcaatctgtagttctgtacttcttttatgactttaaaatacagattgtgacacagcaaagatagagaaaaatttcaatgtgctacaaaggaatttgggacagtcaaaagagtcttttaagctataagttaatgctgataactttcagctcctaccctgcttcctattttgtaataaacagttgctaaaatgtcaaacagggagcaaaggagggaaaattatattttcaataagactcaaaagatcatggcttgaaccccaaagaaaaatatgctctttttcaccaaacctgacaagggtaacatttagtgacatctgatccttgaaagatcaagttcctttccactgctgagcaactctactagctaggaatccaactggcaagtgttaaccgaaccgtttcttctattttttttcctctgacacaaaaccttttattatttattatctgcatctgatcctcttggagatagcaaaggtgtttgttttccaacaatatttacaacctcaaagccttggatttgtccaatgcatgtgccagacatatctgacccctcccccacacatgccaagataccgaacccaacaaaacaaacttcatcaaaagagaactcaagaacaagaagggccttgcttctccctctattttactcacaaccaaacaaaaccacacagaaactcaatataccaaatcaggaaaaaacaacaaatttctcaaaacaacacttctttgtgggagttcttttgttgagacactttcctagtatgacatttccccccatcacatacatcaaagaaacgtttgacttcatattagttttttcctttcttttggtagcaatgaaaggattcgagtgtgatggcaggttgacaaaactttgctcctacaactacaattcctaattaacaaaggcacattaagtaatcaatattctgtaacaatgacccactttctattattgtttaggctcttgttgagccatgaagaagtaagtccttttctgcttcagcatgtcatgctcatgcaggctttaatggagtggaggccccattacagaagatgtctaaaactacatagttaggtattccccattactatatatcctgttccacactaggtaacatatcagctactaggacaatttagttacagttgccaattggtacaaggtttcaagagcttgcgtaaggaagacgtaggttcagcaacttatacagctagatgcctagattttgtttttaattagatcgatctaaacctactactactagtatttaatgaagaagactctttttatttatgtggctattttttatgaagcagaaaattaattaatacattttcttaattactattttatagtaagatggtgctaccgttagttttttttattcaataaatattaatttgttaattttattaaaaatatcgagatttgaaactatgatttttttttttttttttaacttcttgttcaaccttaaatctctttgtgctattgttagtgtgattatgtacgcgttacacatgctgttaagcgtgtcagtaatttcaaaaaaatcaataaaacttaggacaggtgttagaaatacaattttgtgatggataatgctcacacaattaatattatgacgtgtcagagtgtaataatgttgaaatattctgtcccataagtatatcaaatcttggtgaataattcgaagttttaaatggcgactgattaataatgtaccatatgcataggtgacagatgacaattactcaaggtgggtacatgcatatttctcatgtttaagcaaaaaattggtaagagacttcaattcatattatctttttattgatttctagaaaagcatttgcaattacatatcagaaacaaggtgaatgtccctgtcagtttttttacccttttttaccttcttgtattcaattattagccttaatcccctctcataatcatttgctcgtgcctacaaagaaatgatgttattatgagaaacgaaagagaacaaaagacaagaaaatcgtggaaacagaggccattcacaaaaagacatcgcatgactcaagcgctttctcgtgactttgattgtgtttcttggtggaaaatcttgttgattattatgcctactccttaatgattaatgttcttataaaagtctagcacttttcatcatttatttaataatattttgattttatgaaccttttatcaatattttgtgcaacatcatttgattaatgaaccaaacagaaatttagcaattgctaaaccgtgagattaaacttctttttatatgaaagttgggtgcaattttttttttttcttgggaaggccagaaaattttattgcaatgaaaaagaaccataaccatttgcacccaacagaaagccactcaaggtaaataatattatagaaactggattcgtgtagacatcatgcccatcagtccaaaatccatgtgcttaccatatttcatgtatccatcttccccccacaaccacaagcatgacctctcacgaatttgctgtgaatacaccatttatgtgaagtgttggatctattagttaatttagaattggtatatatatatccaatttgcacaagggtcagaatctgagtagtcaagaggaacaatataatctactacaactgtacaaaaacaaattaaatagaacctgtatgatgagtatgaatcagacacagatgcaaagagatgaaaggatccgagcccaacaatgttgtctccttaagacaatttgttccctccaattgatgccaaaggttgatgaacaagtgtctcccaggatagaacggatcaacgtctgaagattgatggcacttcaaatcaacagcccaaacgaacaaagctaatgcttgaggaaccacagagttatgtgatatggaaatgcactagtatctaagcgagaatatcagaaaagattaactatcaaaactctatcagtttttctgcttcttctttctgactgtctctgtgtctatttatagacaacaaacaaccctggtgaagagttgccggtaaaccatcgcgactcttggcgttgaatcatcgcgactcttggcgatgaaccatcgtaaccgttggttatcggaacggttgggagtagttattttttctaacctttcccaagagcggttaggagtagttattattttgaattgttaaccgcctcttattcataacccatggagtttaaataaaaactccaacaatcccccacatgaataagagatcaattcaacatgactaaatgcatatgaatatgtatgcaagtgtgattcctcggcgagaaacaattgcatcgagataggtaggggttacctttgaaccttctctagtgtaaacctatcgggtatactaggtcaatcggtggtcgtgatgccttgaaccgtcgacctttatggtgtataccgagacaataggagacacacaattgcttctctagcattgctcgtcctcattgttgtgtccattttggccgtggacaccttcctggttctgcaagtgttatagagaatcggcctttttaagttctcattgaagcggccctcacttcacactcacataggtgatttcttgtgatatacctccacatatatcatctgaacacatcagattaagaaaccattaaaagccgttatgcttaccctcatatacactgtattgtcataggaatgagtatgagtttaaaaactccacagtgtttaacagtcgatcaagacttagttgtctctttgaacctagttcgtgggatctccactcatcaaggtagagttaccgcgatgatcaacaattgataggccttaaacccattcctttcgacaaattttcaactagctctctaggaatccctttagttaatggatccgctatgttctctttagacctcatatagtctattgagatgattccattcgagagtagttgtctaacggtatcatgtctacgacgtatatgtctagactttccgttatacatgatgttcttagccctaccaatggcggcttggctatcacaatgtatgcctacagctggtactggttttggccaactaggaacatcttcaacaaaattacgaagccattctgcttcctcaccggctttatctaaagcgataaattctgcttccatagttgatcttgcaatgcaggtctgcttggacgatttccaagatacagcacccccaccaagggtgaacacatatccgcttgtagatttagtatcattagaaccggtgatccaatttgcatcacaatatccttcaataactgcaggatactgttcataatgcaaaccaaagttttgagtgtgctttaggtatcctaaaactcttatcatagctttccaatgatacatgtttggattactcgtaaagcgactcaacatgctcactgcataagcaatatcaggtctagtgcaattcataacatacataagactgcctaatacttgagcatattccttttgtgctttagctttgccagtatttttcaatagtcgaagactagagtctatgggattattcacaggagatatatttaaacttttgaattttttcaagaatttttgtaatatagtgagcctgtgatagagccaaacctcttgatgttctatggattttgatacccaaaataacatctgctctttccaaatctttcatgtcaaatttgctggcaagcaattgcttagtagctttaatcatttgattattactacccattatcaacatgtcgtctacataaagacagactatggcaaaccctttatcagtattttgaatgtagacacacttgtcacattcattaatactaaaaccatttgataacataactttatcaaactttgcatgccattgttttggagcttgctttaacccgtaaagggatttaattaagcgacaaactttccgttcttgtcctggaacagaaaacccttcaggttgttccaaatagatctcttcttctaagtctccatttaagaaagctgttttaacatccatttgatgtagttctaacccatacaacgctgctagcgcgactaacatcctaatggatgtaatccttgtaacaggtgaataggtatcgaagtagtcgagaccttcgcgttgcttatagcctttgactacaagcctagctttatatttatcaatagtgccatcttccttcatcttccttttgaagacccacttacttcctagaggcttagtgccaggaggaaggtctgtcaattcccatgtgtgatttgacaagatggatttaatttcactattgatagcctcttcccagaatggtgcttctggggacgttacagcttctttatacgtctgaggctcattttctaacaaatatgttagaaaatccggtccaaaggatgtagtggtcctttgcctcttactacgtctaggttcttcctctacaggattaacactagttgtagtgtcttgaagtctcacaacattatcattgtcattgccacttggttcatatatatcctcaaagaacctagcatcccttgattcaataatcgtattaacatgtatatctgagacatcggatttataaaccaaaaatcgactagcactactattaagtgcataaccaatgaatacacaatccacggttttaggttcgatcttcaaccttttgggtttaggaaccgcgaccttagccaagcacccccacactttcaagtatttcaaggatggttgctttcctttccatacttcgtatggtatgctctttgtcttcttgtgaggaactctattaataatatagtttgccgtcaaaatggcttccccccacaagttctgtggtaaaccggacgtgattaacatagcattcatcatttcttttaatgtccgatttttcctttctgcaatcccatttgattgcggtgtataaggagcagtcgtctgatgtataatcccagattctatacagaattcctcgaaggggccatcatattctccgccacgatcgctccttatagccttaattttcttgttaagttgattttcaacttcatttttatattgtctaaaagccacaagtgcttcatccttactattaagtaaataaacataacagtatctactgtaatcatcaatgaaagtaataaaatatttcttattacccctagatggtacatatttcatatcacatatatcagtatgtattaaatctaccaattcagttgatctatcaacagaagaaaaaggtaattttgaaaagtacagaaacactgattaatcacacagatcaaacagaaacactgattaatcacacagattaatcgttcaaaagtacagagagtagacaacagtatataatataaaaagatagaatatactgaacccagattcaatcaaattgtcttaagattgttggatctattagttaatttagaattggtatatatatatccaatttgcacaagggtcagaatctgagtagtcaagaggaacaatataatctactacaactgtacaaaaaacaaattaaatagaacctgtatgatgagtatgaatcagacacagatgcaaagagatgaaaggatccgagcccaacaatgttgtctccttaagacaatttgttccctccaattgatgccaaaggttgatgaacaattgtctcccaggatagaacggatcaacgtctgaagattgatggcacttcaaatcaacagcccaaacgaacaaagctaatgcttgaggaaccacagagttatgtgatatggaaatgcactagtatctaagcgagaatatcagaaaagattaactatcaaaactctatcagtttttctgcttcttctttctgactgtctctgtgtctatttatagacaacaaacaaccctggtgaagagttgccggtaaaccatcgcgactcttggcgttgaatcatcgcgactcttggcgatgaaccatcgtaaccgttggttatcggaacggttgggagtagttattttttctaacctttcccaagagcggttaggagtagttattattttgaattgttaaccgcctcttattcataacccatggagtttaaataaaaactccaacatgaagccaatctgcagaaagttgagtgcaattgatttcgagttgtaataccatataattaagataagtgtctaaattactctcaattataattttttacattcaaaatgtatgtcgtaataaaaataatttattactggtgcaaaataaagaggcctaagtactctacatatcactttataacattttaataaccttattcggagttgtcaaacataagatgattaaaggtggtaaaactcttcctaattaataagttttaacacatacattctttagattcatattaagagtataagttaaattaaaacaattcactcttaattagtttcgtactcactttatatataacacatagataattaaataatgatgaaatttaaaataaggatatattattatttattgtatatttgtattccaatttgtatttgattagaatagaatctatgaacaatacaaaaaaacaataaaattgaaatttatgtacattttccttaatatataagtaacaaagtaatatcaaatcacctattaatttaatacataaaattggcatttcttacacccctcccctcccaaagagttatatgatgaaacgaataaggttaaactaaaattttaatccttttatttttatttttattttattttaacttatgcattaaaagaactctgcatataaaatttcatgtttcaagtctccgtcaaagttttaccggtcttctttttaccatgtaagagtcaaaataaaaatgatattaattaatcttttatataaaaaagaaattaaaaaattaaaatatttttggaacaagaatcaaaattaaaatattaaaaataaatatctaatttaatatcattacaactttgacaaataaaatgaattaattcataaatattttttaaaaaatttaatgatatactttttataatgtttttttgaaagaaatttaattagatttgaatatcatattaaagttttaacaaggacattttttcatttaatactaaaatgttgatgcggaattaaaataataatatcatataaggacaacttttaaaaattacctaataaacaattgctaatctttatctcttataaactatcaattattctaccaataaaggaaaaaaaaaaaaatatactacagagaatcccacttgagaatcaaagtgacaaaactgcccttcaatctttaaacaattctgtccgaatcagtatgacatttaccagcgatcaaaccaaacaaacgtgcacagtgaaaccctatagttagggtttaattgtcctctcaatttccaccacaagaaagcatctttctctaatttgatttattttttgtgttttattctttcgagatttgtgtttgtgaaattttgctgctatctattcaatcgggctttatcgcccattcaaatccatggtcgtcagtttactatggatccctctcatcagattgaacaacaagaagacgacgagtggggtatgccatttttccttcaatttcgtctctttttttttcttctttctcttttgatctctggatgaccaaaccggaacagagaagggggaaattaggatcttttgtgttgtttttatttatttatttatttgtttctgcattagattgaattttgttgatttattgcatatatgaggatctcatttgattttgacaaggattggttattaattaattcactgctattgcttgagagttcgtcatgttatctggattttattttccggagatattgcttgtggcgctcggtgcttcacatccgtgtgtaaggcatattgttctagcttaatttgatatccagctgattcaattttaacactgtttgattttcatgtaaattagaggtatttagggtaggaatcataatgtcctagcatacagagaatttatcattgatataggtttgttattacatgttgacatgttgtttatgtctatacttatgcataaatatatttcagttttgcaatttattgtgctatatgttttgctatgaaaatgaaaagtctgtgactgtgttcggagttttttttactttctgactagggatagttgtttctttctatttagcaatgttgggatggcttctatggggacaaaaatgcttttgcttttgatgttgaatggttggacttttttttttgttgtagacactgatggatttgtgattccaagtttgggaattgaagactcagatcaaaataaacctcatgttcctgatgtagaatcttctaattctgcatcaaaggtcagctaaagaaaatttcctaatattagagactatataattttcaggttttagatgttgatactgacagggaagacaatgtatatgctaactatatttgtttgtgttctaggctaagaaggaagaaaacatctatttgggcccacatggagcgcctccttcactagcaaagcagcaagagctaatttcatctaaccggaagcaaaagttcaagcaaaagctgaaagaagctgacaagagaattagtgggatgggtagggagaataaagtggataacctgagggagcttgtgggtgtggggaaattaaatgtcaacaatgcaaaggaatctcccaaggattggttagatccacattgccaagaatctgagtttgagaggaggtaatgccctcttagtcacggtagattttgcttttttgagctattttattcttcgggattgtccacttaagcaccttttgttatacaatttgatctaatctatcgagacccaagtatgaggtcatgtacttgacaataaatttattaattagtgctttgataataaaggtattttgcctcatagtaaactgttcatttgtgggaattggagacttaccttgatctcaattgccaactaatcctgatcaaggaaaaatatcaaggagctaaggttcacctaccttattgactgttaacattgaaatctcatttaatgtaatatctattagttcaagatgttccaaatataagtcttttaaaacagaagttattgttattcattcaacaagaattaaacgatatcaacatcaatgacacatttaaatgacacatttaatgatacatgaatctaatgttagatacgaggagattgaaaaaaaataaaatatatatatatatatatatatatatatatatatatatagagattttgagatgaactattatgatataataagaattaaaggataaatgaacaataattacatgaaaattctttttgataaaattattaaattgagtgaacctcaattgtacaaattgtaattattactgattaaaaaattatacaattttcaataaagagaaactaaattatgcactcaatgcacatttacaatatttgttaaaaaaaatgtacatttacaatatcattcataactgttatgtatccaatgcaagtttttatattaaccattaaactcaaatttgaatgtcatgtcatcacaatatatattttaattgtccaacttcaataatttatgcattttccacgctattaaactttttttcaattcattatatgattgtattggacacttgaattattggtttgtattcgaagatttttgccgtgcactatttccagcttcattaatttcaaaacgaagaccgcaggcctaattcatccccgaactgaaatagttagttcgaattgaatatatttagtttacaacaatttggtcatcttggcctagttaataaaccaataaaccatgaagactaacaaagaatgagccgtgtaatacccccaaaacattgtattaataagtgtaatatcttctatatcaataactacaacaccctcagttctaacttctaggtgtccactctcatccaagactaagcactcaagcatatagcagctaaggcagtggcattaaattttatactctgaagaaaccttctcacttgatgcccaagaactccaaaccagttgctttctgtgtcaaaccaagctgagacaagtattcagcatcatagaatttgctcaaatgtctcattccactgtcgcagagaatggttacaattgtgtgaccagtgccaattgcttgcgctactctaactgctccaacacagttcattgcagaagaactcccaaggaagagaccatcgttcttcaaaagaaacctgatacatcaaaaacaacatatcactttatttcatcatttcttcaagtttgacagaaaagaacaaaaaaccgctaaaaataagaaaagtaggatggtttacaaaagagtaagtaacaacctagacatttcaacagcttccctatcggtgcctctaaaggccccatcaagttttgccattgcaaaattccttgttatcctgttaattccaattccttctggtatagtgtcaaatggattcttgagtcttcttccttctgcctcctctttggtgtacatcactcccctagttaccttcttaaacaaacaagagccaggaggatctacgaggaagcacttgatgtttggattcttttcctgttgaatatagaaccagaaataactcacataactttcacactcaaaacgacaacatctacaacctggaggaaggggggatgtggtgaacctgaagaaacttagaaacaccagccagagtaccaccggtacccgctgatgcaacaaatgcatctaactttccattggtctgctcccaaatatcaggccctgtaccctcataatggaccctgaagttcgctaggttctcaaactgatcagcaaaaaagccaccttgacaatcttcaaaacagagagctgtaattgcatccattagattcataaccatttattttctcggtgtcctccttgccattcaattgttatgaatttctacgcttcaatgcaaactcatttgcttcagatgctggtcttcttgcaatattgacaaaatggtctttgtgggtgatggacaccggtctcactctttcaacagttgccccaagggcttcaagtatttgagactgaaggttgattcatgcaacacaatcatcaattgtacacaaaatcttagaggtttatcgctagatttcataacagaatttacttgattacattacaatcattataaaataccttctcaatggcagcatcatctggtataaccacgtgggtcctgcacccataggcaggagcaacggtggcaatgctaatggcagtgcttccagcagtggcggagccacattgaaaccagcggggccatgacactacctaaaaaataaaatttggcactacctaaaagtaaaagctggctccgccactggcttccagcactcccttcagtgattattccacctggacgtagctggccagattctagagcctgcgcaatcaatcatagggacaatcttaaggctgatattgttatgacttaagcataagagggaagtccaactcaaaagactagttcatcaggttggagagcctcatgacttaaatatcacattaaacttcttattctacttgatgtagaactcataatttaaatcatgtgtgttaatatgttatcaagcagattccagatatcttcatatcatgcagcaagttgtgcatatcatgtaagtatttaagtaaacatagcatatgcttaggtgaaaataacataattgaggcaattatatatagaaggattgtataggtggtacatgtatatgtatatcagattgagaatgaatgaaaaattgatattccatccaaaagaaagcaattctgataattgtatgaaaaacagtgaataatagaagatgcgaatggttgaaataaatagatagagagcagttgtttaacctcatgaataatttgaacagcaacgcggtctttgacgctacctccggggtttaagaactcgcacttgcctagaatctgaagagaaataaaaataggttgagagtggaattggtaaagagaatggaagcgaagtgatcatagagaacataaatacttggcaaccagtggcggcggagaggctgttgatccgagtcaaaggcgtgttgcctatggcgtccaccagtcccttcttcttcttcttccttgattcgttcttcttcttcttctatcgaagggagaactatttttatagcatttttttcaaatttaaaatgttgttctctctttcttcttcttcttcttcttaccagcaaaaaatattagcaatatatagtccgaaaataataaatgatcatgagcaactagggcaacacctagcacgtgcagacctaagctcaaggaatgagaaaaaggtaacaacaagccaatgttcaaatctactatcacaccgccaaagtcatgactcaagactcgtgtgattctttcagtcaaacttttcttcatcaactaaagacatggaaatatagaggagtgcaatgcaaactgtgcaagcgtgtgagggacacaccaattgtagacagatgtactacttaggaagagtcactttcaattcataagatcataaactcatcactttttgaatcatcatttcaatgtgtttggataagatacataattgattttgggaacaagaactgtgtgtgtaatcgtgaattttgagaagcaactatgtgttgctcatggtcacaattttttttttcattgtgccaccactccaaatacgcatacaatgtaattgacagattttcataatcgattatggaattaaaaatcatggtgtgaccgtgaattttgagaaacaactatgtgtggctcgaacttcaccgtgggattggtcacaattttttttatcatgctgccactctagacacacactcaatgtaatagactaattttcacgtttgagtttgatatgtagctaaatttaaattaatcgaataatctctttttttatccaacttatctcaaataaaaatggaattaaataatctcattgcattttatgggtatacttaatatttgcaattaataatcttaaagtatattaatgattgtattgatcaatgagaatgtttaaccttacttgaagtgaattagacaatctctttctttaatttcattattctcagtaaaattaaaatgtataattttcgacttctgcccaggttcaacttataaaaaaatgaagtgtgtaaaattagtgtgtgcgagcattattaattttaagtaaaaactctagggaacaaaacggttcacacgtgaaccgaaagaaaaatgctaatatattagtatggttttggggggatcatgaactaatttatttaaatttatttattgaaataaatgtttattttaataaaataattttttaatgtgttcgtctaaattgtttatgtttaaaaaaaatattttatttattttaataaataaatacttgataagttttgtttaaattacaaatttcaaataagtgattatttaaggaatgggatttgttttttaaaataagaaaaaacaatttttgttcagacaaacatactaaaaaaataaaaattacttattttaacaaataaatttaaataaactcattgaatatttgtttcttaatttttaaaataaattcacccaaaatgatgattaggggagtgaaaaatgagtgtgttcccttgagtccaaatccaaaaaacgagcagaagaaacagttgttgtgtctgaaagaatctctgcacagaaaacccaaccctgagtcacactcacttgctccacaccacatggccatggagatcccagagaagttggtaaagttcagatactattttctcggggcactgctcttctctcttatactgatggccccaagattcatgaccctcttcgcctatttctggccactcttcctctccacagctctagtccttgcctttctcttcttctttgctaagacttctttacactaatcctttcatttaactctacggggctgtaatctaacactaattatatttacttcttctcatgctaagttaagtcatgtgaagtttcaacagatcaaagtcgctatctttatttcaaaagtattaatttaaggcgatagttaaatatcagtgaaattaatgagtttagtctacaatatcatgaatcaaaattttaatctcgtagaaagaggtgtgtagtgtacatgtggtgtcggcctcaagcatgattgtattagtagaaaactagtgaaaaaatgtcggttcatttaattaatgtttaaaaagttaaattaatcgcaacgagaatgatggtttttattcttaaaaatatactaatgatacgagggattttttgaatatttcaagcccaaaacagaattttactcgattttaatttcttataattatcactatcattggcaagctggcagctttcttttgtgttttgttaaggataactataactatgtcttgacgggccattttaacggttgagttgtgtactaattaatgttgttataactctcttagtttttccttaaaattattttagctaaaatatgaactgaaaaatggagttgcgactgtggcagagtctttttgagtgatggcagtgtttgagtgagggtgtgatcgtgaatgatgagatatgctcatatgccgtacatgttcattgacattgttcatgaaaaaaatcaccatcataatagtcaaagtttagcatctgtttagaaatataatttgcacttttcaaagttgaaccaaacaccaaaatttttaagtttgatcagttgctaatttcttttaaaatttaaatagattttggttgtaaattattttgaatagtattaagtaagttaatctaaataaagtgtattctttaatggtgggaatataataatcgttctcgaaagttatggaaccgtcgtagtcgacaatgcaccatgtgccatccatattagctgctgaatgttcatttgtcaattactagccaggggacagaattcagatgccctgaaaaagtaatattacggggagaaaaaaatataatactattaattaattaattctaaagtaaatactacaatttttaatccaaaaattgttattttaatgtggtattatctttgcatattgtgaatcatcttgttttgaagggagctaccttctgctatccactccactagtatatttggtaggacactaattaatatttgtttattttataatagatactcttttcgcttgagagattaatataagttatactttaattcttttgcatataaataaaccttttcaaattgacgaataaatatgaaagtgtgagcctataattaatcattattgttgatagttattattttttactggtgttttggtcagaaaaaaaaatataaatgtgtgtttcaatgatttttttacaacttaattcaacaattaatttgtaaaatctaaatattatttaatattttagaaaataaagtaaagtcttaaacacttattattaacttaaattttttatctaaaatatttatctcattttataagatcacaaaataaaatgtagatgtttaaaaaaggctattaatgatgttgagaatcgccataagaaaaaataatctaaaatgttcatttatattaaaactcatatataacatatgtttatcttttaatgaagatgtatgtatattttttttaaaaatgaaaaaatatgtaatttaaatatcgaacgtggaaagcgcaatttactctttttagtaataatctgttaatcttacactgaaataacccggtaagaatattttaaaatatttaactttacttaaagcgagagatgctgactcacttggagggagcaatgatattcatgcaaacaaaagagtttttgccaagctgctaatgtcagacaccaaccaaatttgatatgataagattgaattgaaacaaaaccaaatttattagtattttatgtacgaattgtgttgaatctatttatagctatttgtctttgcaagtgaatcggattatatgtctttacagatgggtataatcgtgtaaaagtgatgcataactgatagcataggagacaatgggtacgcaaatgccattatttttaagtttgaaaaattcgtcggtgatgttattggtggaccaatatcattttttgaaattgactgcagtttgcaaacaacaaacaagccaggaacctttctgatcagatcatatataaagggttaaaaaaccagtagtagtagataacaactggacaactttaacccatgcttaattttttataataatttgaaaagttgttttttagaaaataaaagtcttctaccacataagattctgaaaaaaaatctctcgtcttttttattattattgacgaaaaaagcctttttggatataaaactttaaacaattcaaacaattcttaaaggaaatttaaaaacatttttgggggtaaaattgatccaaactttggctgatttttaaaaaaaatacaaattaaataaatatttagcaaaagggggcgaattcaaaattatttaggaaaatggggtaatgcaacacgcccagctggggcgtgtataccacccttgtaacgcctctctttgctctctcgtgcttgattgattttagatgagatttcatttctgctttgtatttgaatggttttagttgtaaatttttcacggaaaatccttttcttcttgctctgatttttcctatcgtttataacatagacgattttccttcaccgcgatttatttaaatacagtttatcaatacaaattagaatataaaacagtccatgttacatgtccataaataaacggtccaaatacatatcataagttacaaaataaaaattacaacatctttacttcatcttcaatttaacatccatacacatcttcaatccaacatccatgctcagctactattgttcatctgctcgcccaacagattgggatcatcacaggtgtcaaccaccgacacaaaatagggtaagcatatgataaacatagtttgaataaaacatatatagacacagatggagaaaaccttaattagaaaaaccacataacttatacagtatacagaacaacatacatagatccatcatgagatgtatgagatgcatgctcatctttttatatgatgcatgactgagatcccagcttatcataaaatggtaccataatcaacatagtttcacccactctagtgaaacttccctccactctgaggggtcatagtcaaaaatagtttcacccactctagtgaaacctccctccactctgaggggttagagggtaccatagtttcacccactctagtgaaacctccctccactctgaggggtcaaatacagatgaactatgccatgacttgtttttatttcttatttacttttcaccatttattttatttctcaaaatctcagatcagatagttccacccactctagtggaacacatcacaaagctcaacatctttgaccattcagagcatatacttttaaacaacaaatcatcatatcaagctttacataacagccatatttcaacttcataaattcctcacagataaatcatagtttacatggaaaattccatagaaacactcagcaacacatgggaaacactcagcaacacatgaaataatacataactttcattaaagcaaccaaccacacaaatataattcaactcaacaacaaggattcaagccaacattattaaacatattttgttcattgtgacatattatcaaacacatagtgtgcaagctttaaatcataaaattctgtaaagaaaactatttaaatcttaaatttcctaaaattcaatataattctagaataacatggttccaacataattcctagcataaactagacatatttcaagaattttcaaaacacttttaatggaacttataaattttagtagaacataactactttaattttagtaaaatatttgtttttcttctaaaatacctataatggactcattcattaagttaagctctaattatttatatatcaatcattctttaacctaaaaccaagtcatttatccaagtaatcatgttcctagcaatctttatttctttgagacatttcatcaaacacttagaatacaagacttaatcaaatgaagcaaggaataatattcaaactaagctatcataaactcccccatacctttgcttttccttgccttagaattggacagccctttgtttccttatttgaatttgaagaacccttgctcttagaatcccttggcttttacgtgaggtattaaaggtgaaaggctttagttttgtttttggtaaagggtgaagtagaaaaaatggaatggaaggctttttagagtgattttgcacgtcctagctccctcttggagctgcccattttcggttccactccctttatatagtggtcttgctacaaaaatcatcttaagtcataacttttgatcgggacgtccgattgagacgaaaccggtggccacgcgctcgaaatcgagaggaagagccgctggcaagttcccaaaggggacttgcccaaaaaagtttcccaaacgaggcctctaagtgcctcaaatttgcgatttagtcttcggagccctaaaaaaaatttctgttctctggtattttgtctatccaatcagtgaattgcaatccattctttgtttatctaattacttctcttaatttcgaacgttttgacataaaatacgtcttcatcgaatatttctacgagaaattacgtctgttcaaagttatatacaccgtcgaatctacactacaattttggattatttatgcatttgttaaaccaatgtggattaattaactgttggatttggttaattgtttagggtttagggcattgggttaatgattaactgttggattaggttaatggttttagggcattgggttaattgtttagggtttagggctaaggcgtagtgtgtttggataactgcatagtgttgatggttttagtattaggggtttagggctttgggttaatgattaattgttgatgttggttaaggggttgggttttacatagtagtccttgtcatagcgtgatttgattccgcaagagccatggccacaagggttactctgagagtagtttgcgagaattaaagggttactctgacgaccatgagcatgagctgatgaagaaggtgaatgggagaaagacatgatcacacatcttctttcttggtctgttttgcatcttctctgtgtatatgatgatggacttggcacaagtggaaataatgtacgtcaaggttcttgcttttggaatgttttagtattaatagaagtgtactatgaatatcagagggctgatgttacatcttgtaaatcaaatttaaaatttgagctgtctaaacgacacttttgaacagacgtaatttctcataaaaatatccgatgaagacgtattttatgtcaaaactttcgaaattaagagaagtaattagataaacaaagaatggattgcaattcactgattggatagacaaaataccagagaacataaattttttttagggctccgaagactaaatcgcaaatttgaggcacttagaggcctcgtttgggaaaaatttttgggcaagtcccctttgggaacttgccagcggctcttcctctcgatttcgagcgcgtggccaccggtttcgtctcaatcggacgtcccgatcaaaagttatcgccttccgtaatatacgaaaaaaccgcgaaaatcctaagtccccttttttgcctgccacgtggcgccatgggagcaaacacgccccatctgggcgtgtttaaacacgccccagctggacgtgttgcattactccattttcctaaataattttgaattcgcccccttttgctaaatatttatttaatttgtattttttttaaaaatcagcctccaaactttacttctataattttgtgcactattaatagttgctcaaccatgaataatagcacaatttttcatctgttactcgggactaagtattaacctcataaagctttcgtaaataaaacgtttaaagccatattttttatttttggattattgtgttatttgtatgaaatatttatttattgggccatctctaataacgtgatattgataattaattatacgaaagtgatttgtcaaaaaacaaataaaatgtcttttgttttcaaaaaaaatttaaagtataaaataattgacaaaagagaaaacagagagaaaaggagcaataaaaaaaaatctttattttttgttcatgtaatgatgataagattggacttgtatttatattaacaaaaattgaagaaataataaaattttgttcatgacctagttttgctggcacaatccaaatgcattgatgcaacacattctcaattttttttttttatgtgtcaacacccacccaaaaaaattacatgtaataacttgggttaaatgtgttgttgatgttgatgttgttgaacctccaaatccgtgccccgagctcattctacttgatcgaagaaaaagtgtaaaccaaggaggaggaaagtgtgttttgaattgaatgttccaagttgatctatgtatattaagctgtaaaatacaaaagactctgaactgaagtgtaaactgttaagcttatatacttacatgatatgatatgtataagaagctcctgatcaagtagtcaataattcgatagcatgagactgaccaataagcgccagtccgttcaagaaatttcagattttccatcctcatcaaagctctggtgtggtgtgcattacgtgatcaaagtggaaaataagaacactctgcaccaacttggtgcaatgtaatgtgttagtctaagatgactgagcaagagttatatcagaaattgatagtgtgccagaatcatcaacatcaagctgtttaaactcctgcatcacaagtgatatatcttcttgactaatcttccccatctctttgagcttataaataacgaattccgcagccctatgagaaacaaaacaaaagatataaaaatgaatgaagacatgttttataattgatagtataacaatatatatgactttgaaagaatgctcaactaacccaacagtcccatcctcatcaagatctgcagcctccaaatctaaattggtcactttccttgtaagtacccacttgacaagttccttttgtctgatttcagtgtttagctcagcaatgtagaggaaaagctgagctaaagtaatagtacctgtcaatatccaaaacacagcaaatgttcttcctgcttcagttgagaaactttgatccccataacccagggttgtaattgtagaacaaacacagtagaatgcatcaataacatccaatttctcaaccgtgaccaaaaaaattgtgcccgcgatgatgagaatcaaaagaaggaaaaagactagaaataatttgtatcttgttttattggtctcaacctcccttaaaatttcagttgaaccaactttttggtgcttgcgcatggctttaactagcaaaaattcctgtttctcaactaagtagtctgctgctttgcttacaattagtccaatcaatgccatcccagagaaaacaaaagcacatgcaagtagttttgtaaggtggctatttggcacaaggtctccatatccaacagtggtcattgtcacaattgtaaagtacaaagcatcaagaattccatctgttttctgccccttaatctggttcctgacaaggtagaagattaaagcacctacacctaagtagactgcaagatagatagccactcttttaaagcttggatgtaaattctgaaatatggacgcactatggggaattgattcattgccatttgtctcagtaggaacaatttctgcttgaggagcacttctaaagcgggggagccttctcttgtttagctgctgtttagtcttttgagtcgcataaagtgataccggcagcaagggctcctttacaccattgttggccatgcagaggaatttagaaaacaaggatctgcaatataggacctgattcaattgcaaaacagttcaaactagcaacatcagtcaaataagaaagggatgtaaatgaacatccataagccattgttagacttttaagtatttaaatgatgaagcatgaaacataaattcatccaaagagctttcacaaaaaaataaaccagtatgctcaaatatatactataataataggtgccagagatcaatccaagttctactttgagcttaccaccacaaatgcaaaatgaaatcatttggatcatcacttacaactgatacgagccatatggatctcctaaattgcgtgccttcatttaaagaaaaggcagaaaatgcatccatttcttcggagctagtgactttgtaagcaaaataactaataggccataaaagtagcataatagcattgaaatacaatgaatttgcccattatgctctacatgccaaaaaaataataatcatagagcaaacgcaactagtgaactaggacttcctatttacctctcaatttcttaacctcaaattcaaatccattcaaattctaatgaaacttacatcagcctcatcatattgaacattcccagtttagttctcattacaaaaaaaaaatagaataaaagggccattagtcatctcacagaatttcaccatcacaagtattttcctctattcatgggcaatcctccaagacaaaaaagttcccataaacagtgacccaaaattacacaaacaagtcggggtgtatcccttcaaaatcgtaacttgcaagagccatccgaaagaaatgaaatatggttgaagatcacaatctaaaagttaaaaaaaaaaaaaaaaaacctccttgactaagacttaagacaataatgatgcattcaatttgggagaaactaaattaataaagtggatcagagttgaggacaacagttaatacttaaaggttgatcatgtgaaagacttatccaactgcagttcatgtcaaggagcattagatttccagaaatagcaacagtgctacacaagttcaatctaacacttttttgtagagaataaatctgcaaaatttaaaggtcatggatgactaatcaatagcaagtgaacaggcaaaagagaattaaaacgaaacaataagcagtggaaattccaatcaattatgaatcgagctagtaagagaaagacatgtgttgaactaagaagccaagaggaaaacaaacccatcacaataacaacaaatgtaattcgtaattgcgaggaaagttctaacctttgaagtggtttgttgttgttgctgaaggagatgagatttgagtatggcgaaggcttctgaaagcttgtgattcaatgcaagtggatcccatatgatctagcttctccataattaatcatgaatcaattccgcgttaaagagattttgtttatttaacataaaaacaaataaattatttgaaaaggacaaaaattaagttcccatatatgcgccccacttggcagttgttctttcgagtttcaaccatattttgacttcttttttaaggcttgttgtcggaaaagaaaaaggacatggtttcccatttattcatggatgactgccgactataaattgtttaattatattttatttaacagtaagattttattaaatgatatttattttaagaatttaataataaaatttattaaaatgagacaaaaggaacctacttagataagacatactaaaagatttattaaaataagtataaataaataaaaagccactaaatactctgaactaataacatgttaataaaaaaaattataaattataatcttttcaaagtaatatttacatttgaaagatatatatttatagtcttttcaaaattttgatgataatcatgttactaatttagattttacaattgcaactaatcagcctaatgtatatattttttaaacatattttaaagaataccaacttaagactaagaagttttaggactcgttttaaatggttattcagtgttgtgttcacatatgtttgcaattttctataattaattaattatgattaaaagattgttgaatagttcgtcaaatgaattgtaattgtatttttaatcaatatttttatattcatcatttttataatcagttaaaatacagctaatcgatacaaatatatgcacatatagagcacctctatcacaaagtgttaaatagaaataactctgtcaacaacccattttactagatttgaccatttgagagcaaccataggatgagagagaaaatgtttgagttgctttggtcccttggatagcaattgttctctacaaaaaagtgaggcccaaaatttttattttgaataattagagatacacaatatagaagagtaaggtatttcaggacatggacttggataatggataatgtctagcccctactctatccaatctctattcatttctacatggtgggtctttctttctccatttttttttcgtgtttttccttttgattttttgttttgttgcaaaaacaatagccaacagggcataagatgatctaatttgggtatattgtgagatacattaaaaaattggttaacttttttatttttaaagttaaaaagataatgatatcaaagaaaaatatgaacagctataaaatattagtattagatacagtaattaataacccaagtcccaagtgagttgcttaaatataaatgttgtttcatacaaagcaaaataaagcaatgtatgtaaactatgagaaaatagccaattaccaagtgtcaatgtgagtaattttttaaagtatcattggggccaaattaatgttagagggtattttatttttaccggaataaattttaaatttttatctaaaagggataaatcataataatttattactgacttctgagttttaaatcctacactatttactatttttattttttgttttttaaactgaagtggacgtaacttcgtaagaggctaggaagaaattggcggtaaagttgagcaattttttttatgcaaaattaaaaccttgatccaaaacaacttaacctgttcaatcaaatattcatatattaaaatgacatactgatttttgtttcaatgcagatcagccagtggttgaccaagcaattaatgatatatgtattcttatgcaatgcaatcaccgtaaccttaatacggtagtttttcgcactatcgtttttgccatttttcttttggtatggctcttggtggattttggtgaataaaacttctatctgagtttctgatatgcttgtttttctattatttatttgtttgaaacagaaagttatcaatgtttaaggtttaaatgtttgggatgcttatatttcttttattttcattttttgtaggtttctgcagggaacgggtacaaaatgagatcaccctcaatcttggaaaaattcactttgttgtcagaattttcttaataataataacagtagtagttttattttcacatataatactgtttcatgaatgtgtgtacatttttgtataaaatacaatctcgccactggcgtgtctaattttttttatgaagttcaaaagacacgtatttttatgagatcccctgcttttattcatattataattataatttatgatagtgagaaaatatgattccattaaacgtgcattattaataaggctggcatatgtggcattctgtcatcaaaattctcctctactgctgcagtagtaattattaattaattttctcaaagctgatagttttgccttttactgagtttttcatattgtaatgatgtgtgctaatgtgtttaactggcaagtggtaagacttatggatcaagtttgtttctgctgtaggttaattatgggctggataagattcactgaaggagaaaggatatttgattgcataagttctcccaacactgtaagaactaagaactgatcttaatgtagtaattatttttaccatttaaattatatgcaggcatttggcttttctgcaggcccaccatgttcctgttcacgttgaagaagttcaaggtatcctattttctgggtgaaaatactgcaatcgtttagtttccttcttataattttatttggtacttcatattaacttaaaatgcaaagtgattcgaaatggagagaaacgttgcttaaccttgtgcatagatatcattagtgttgctcaatacatattagttgtggagaaagaatcaggtaagcaaatgcttttttgttttggagaaaataagaggaaaaaaagtacaagattcttccccaacttacttcctattgaaaagaccgtccatgttgaacttcactttcagttttccaaagactagcaaacgaccaattctgcaatgcaaatcgctgtattgtcatcactgtaagcaatcttctgaagacattagtttcgtttgcaacaatgtttctttgtttgaattctatctttatacagggaagaggctacccggatattcctacaagaaggtgcgaacttttgttttcatttacttgccagcttgccttttcatattgcattgcgaatgtgtctgtttgtatcctaacaggtttttgcggcttctggttgagaatttgcgtctacctgcttattgtttggtagattgtgatccctatggctttgacatcttgaccacttacagattcggtacaatggttagtatttataagtttattaattaagatatacatcaacatgtatatcattatagggatctgaatataaaatgtacaggatcattgagtcacttgaatctctgtaatggctgagttaaagttcatatcctgcctgactaatctattccccacgattatgttagcaaatggcgtatgacacgaaacatcttcgtgtcccagagatacactggcttggagcttttccttctgattctgagagatattttgttccaaatcagtgtctccttcccttgactgctgaaggtaaataaggatattacttgtaatgcgtcagatcgacctagttacatatctgatcttataaataccgtggtctcaacattccttctagacaaaagaaaagttgaagccatgttacttagatgctaccttcaaagggaggtaccacaatggaggtattgttcatatacattccaaaacatttgtctttttcttcaactgtgtatcttattgtttgttatgaaggttggagctacgtacagttgatactgcaaaaaggagtaaagtttgagattgaagctttatctgtgcacgcattttcattcttgtgagaggcttacataccaatgaaaattgaatgtaaattgataatgtagcatgttggacatctatgtgtcaagctctgtaccagcaactggactagggcataatcagtacatgccatttgttacgcattctggaagattaaacgatttcttgctgactcgcgtcccacacaaagttattactcgtgtctttgttttgtgttttcgaaattccgcttgttttgcaaatggtaagtttagttgtccgtgggggaatgggcttattggcatgtcggggtagaaatgggtctgtctaggatctttgaggcaaatttgtctacccaatttaaaggttttatgaacatcgaacagggttttatgttataaaaaagagagggttttataagcaatatggaacgtaatggtcttcggcatttatttgctatgatttggggttcatgccaaaattaaagtgaatcctataataattatgtactcataatgttatccttttctcacgggttgctcataatatcatctataaacttattaataattttctttcattttttttgtataataaatttatacaattttgtgtataaaaaaaggaaagatataaagaagagaacaagaagggtggaataagataattaatgtaatagaaatagagagaaaaaagtgttaccaaaaaatgttatacaaatagtatcctcttattaaaatacgtacaaaagttgtggatgcacgtaagtgtgcaacacaagttagaaaaataaatcctattaagttttccgagatatacttaagttggccttttaacatgctttgttagacttaacatcacatatgtagagtctaccgatgctagaatttagaacatctcagaaaacactagtagttactttcaagagtcccccaaaagatgtcgtgtacaccacgtgtgcactccacttagatttctattcatgtatttgctttcaagcgcattattgacataaaatctgtgatgtaaatcaattgcaagcatacacctcccagttctcattctcttcatgagattaataactctattttcaaggggctaagccaccgaattaaaagaccccacttcattattttgaatatatatagaaatgcattattggtatcgaagggacaatcatatctactgtcatcatcaaggtgatttatgaacacaacttcatatgtttagttttacacatcaaaagcgacttcttctaagccaactaatcaataattttatctgtgagaagcacccttgccacatgatatattagcgctcacttggacgctcatcttccctttttttatgtaacaatatacatgcacttttccatattcttcatcttggatttgctttgtttgtattgtattaattattgccttatttatgcatgcatgaatcggtactttgtaggacacaagaatagtagtttttatctagaaggaagatatctttagttagactttactactattatgtagtttttgtctcgtgagagttagtcttagtcccaccaagtttggcagggtctttccagatctcacccaccttgatatccgctctacagagagaaatatcaaacaaaaaacctttcactttcgagactgacttcactttggtagggaggatccacttgggacttagcttcatttgatcaaaatccatttaaggcagtgaaaatgaaaggcccatagttttgtgtgccttatcagtgtaatgacatttatgaatttttggccatatgtaccatagcatgtaattgacaaacccttgtgttgctttcagaaataaaaaaacaaaactctctctattcttatgctgttatactaacttactgtagttgtttcaagtctctaagttgtactattcccatataccatgcgttgtccttgttgtctttatacatgaatagatattagcaacttgatattgagcacagaagagtaatccctcaggttttaggccgtctaggaccatatttctcctggtcctggcacagatatcaatatgggatggacaacagagaatatcccagagctgtaacatggtctaatgggtttgactttgagatcgaagggtccagaaaatggtagtgctgagttaaactttcgggtgaagttacattttatgtgtgggaatgaaggtgccacatcaaagttacatttttgtttacagtgttatgcaaaagtgaaactgtagataaatcatgggggtatctggttgcaaagaaaaaagttattgcatgctaagtttgattgatggattctgttccttgcggatgcattatgcatatgaaaatataggcattaatatcacttaacaaacctggctatacttaccactcagaaatttcacaacagtgtcttgttataggctataattgtttacaaaattaatttttggagacaaaatgcctatttaacacctaataaaagacacaaaagagaaaaaaatatataatatgataagtgatataatgtaataataaaaaagatagagagaaatgatgaatatttataaaatgtttgaaaaagttggatgtccagatatcattgtttttgctcaattgtttaagtgccttcaacttcaagagtattatgttacctaatagcgttaaagggcaaaccaaaccaaatggtgtgtaaatacttgatagataagtatgcgggtagaaattaaatcttaagtgtatgaaagaacatatattagaagatgttagttttttaaacgaatattaaatcataccttgaagaattaatctatgactcttgactagagaatttcttggattaaattaagaaaaacgtttgagatttgcgggaagtttttgtttatcgaatttagaaagatttcccaaataagatttctgtatcaattctttgaaactgaaagaactgtgtcaactatgtattgatatattcctgggccatcttccgatttgatatttgtgaaacttcactttcataaggtcgtcttatgctgggtgcatgcaatcattgacttgcatttgctcctagtcctagccactttgtgagacttatccatacgtgcttcaatctttctaaagcataaaatgtgaattttccgtgttggatggaagtaattaaaaagaataataactaaaggacagtgcgttgagacacagtatcgttcgttatagataaataactaggcatggcagcgggactcgaacccgtgagtacctgtccgaatccgccccgattttaatagaaaaaatcgaatttttcgggattgggtttggattcgggttttccccggtagccaaaagcaggggcgggggcgggtatggggttactgatacccgccccgcccccgccccgtaataaataatattaaaaaaataaaaaatattattttctatttttttaattgaattgattgattttgttttataattttaaaattatgatcccatattttaaatctggatttgttattattatttttttgttacataattaacttttttatccaattgttcaataaaaaaatatattatttttttatttttaaaattttaattaaatagcgggagcagggggtggggcggggaaaatccgacccccagcggggacggggatgtggatgggttttaaaacccgacggaaaacgggggcggaggcaaagagcggatttgggggcgaggacagagacggagaatgcaatacccgccccgcctcattgccatgcctataaataaccattcataaatggctaaacatgcaagtacttacaaaagacctggtttttggcatagtatgcaagtatcatactttataataaaaaaattcccatagctactatgtgtactaaaagtgttcgatcttacgaaatttatacaaatgatcatggtttaatattattgtagggtgtaaaaggtgggtttctgacagacattaacaacgatagtaaattgtagatttcatgcatgcatacatcttcataataccacttatcactaactaaaattatagtagctctcacaaaagaaggaatttaaattaaattaccgtaaaagtaattacatttttttaagggggaaaaaggcctctaataaaccaaatagataacttaaaataataataatataaataataaaatcgtacagttttgtactttgcattatctttcttagctataagccagtacctaactgatgggctgacctgtatgaatcagatttgtgatcgtgtaccatttgctctggctaataaaatcgcaaatcattttcaattattcgtaatactgttggatcatacagaaaaagactgtttaagttcaaccacagttgaacaggttttcttcgatctagataccacgtggtctcatctttcaacaactaattgaacatgttgctataaacatagtatagtactgacattcttcttaaatatcaatctctgttcttaaatcacttgtttgtttgcattcagattactaatttttctttaataaaacaattggaactatcaaatccactctcaaataatttctctcttgcatgtcaagctacgacaaaatactgttgccagagataaaatttcggctgaaatgttacaattttttttatcaaaaaatacaaaataattttttttttccttttcaccctattaagatcatatcttatcatttaagaacaacagtatccaaatttatttctatttcgatgcatgacatcatgttattaaatcctaacagtgtatcgcatagattaaatgagtttagtggaaggggatagttttgattatatactcaaactgtgtcatatacgcgaatttacttcattaacattgtgatcatgtgcttggtttatgacttcaatttaaacaaaattttcatatccaaagcctgctctttgttgctaccaatggcagaaaagcatagaaataattttggaaaatttcaggggatgcatactacatacaactaaagtacaagaaaagtggaacataaaaggagaaagacctaacaaataactaggcctccctaagaaagaaaaaaaagaagaccatggttgttactaaatcaaaccatgactaattgccgttgagcttcaattcttagatcttccttcatctttcgaatgaaatcttcaaactttttgttcaactcctctgtgctcaacatacagctttcttcttcttcttctacattttcttcctcatcttctatgctttcttcaatcagaatgtaatcagtttctgaccctttatcttcctcttcatcatctacatccaattgttcagtttcttcatctagctcctccttctcctcttctttcaaaaccaagctactttctttttcttgtccttcatctaccaaaatgatcttctcaatgttttcttgtacttcttcttcagcacagttttctatttctattacttgctcaactgcagtgttctgttcatcaggctcactagtttgttcctcagtttctactatctccaacattagctcgttggcttcaataacccaaaaccgagattgtgaaccatcatctttaatatacgtagaaggcttattatcatgacaacaactagacctggagagagatttagttataccaacaaaaacaaggataccattgcaaagtagaaacatggagttcttgtctatgttgtgtgtataaagttggaaagggaatgtagagaaatagaatttgaagtaatgtaggaaaacaagcaaggaagaaggtgagaagatgaaggaacacacggatactgaaacgaacaattgagtaagcttaactagatagtaatgagcttttaggtggtgagtcatggttgctatattttggtttttaagttgataatccatagtgtttaaaggaaattaaggaaatgaaatgacactaggaagggttggtgacacaggttctgtgagatggtgtggtttggtgtatgagggaggcctccttatatacaatggtggggtgagagattctatttttgggtttccaaaaatgcccttggatggaaaattattgtgaggcagatagcatattaggctcacctgctctttagagactttgtcaattgtcatgaagggtagtatccagttgtcagagtactatttgtaacagaaattgacaattgttttcttcaagttcgcctgtttgaggttttctacatgtcaagtggaatttttcaaagtaggggccatatagagagagagaatgaagcttaggaagacaatcacctccaaagtcacctcccactttaatcccataatataagtttaaaattaactgctcaatgcttatgtactgagtaattgtgactgttggatacagtgagtttgtgtttcagcgttccctatgtgagttatttttcatttccgcgtcaaaaatttaagaagatccaaaagccatttagatgcttcagattggacgtggattacaaatgacaaaagttaaaccaaacatgcattataataagtggcaacaatgatcaattgatcaaaccacataccacctgatacgtatattatatacaattaagtgtggagattaatttttttatggctaaattttactggatcttaaggagtttgttgatgcagaatataattgagtctgatcataaaaaagattctgagtatggtccactcggagacgggtgatatcagtttcagtcttcgtctctggaaattcaaaaaatcggacttctctttcctcctcctcgaggatgatggatccgtgcgctttccagaggcgaaaactgaaactgatatcacccagctccgggatattaattgttgttaacaaaagacctatgattcttttcattttttcattttttttaactatctaattcaccttatattaagcttgatattaattgattttaggttattttaatttaattaattgtttcaagttcgagttcaaaaatgacttggagagaaatttttgctttttataacttgatacaatttacaacatatattaattaatagaaccactttaaggttttaatgcattatcttgatgaattgttgcaaaaatataacccaattatatgcaattttgtgagatttatgcgaaatttttaactgaaaaataacacaacaaaactgcacttataaacttttttttcttttatttttcacttatttagattttctcgtgtacagttgaactgtttcgtggaagggttgtctgtttgtaggccaggccttgtttttgattgggcgggcctttttatctgttgattcgttcataaaaaacacaaccaaagaggaaaataaaactaaaacagtagaataccctaagcacaaccaaagattaagaagtccaaagcacggcttagcttacgaaataagaaatgatggaataactggtagccaaacagggcatagccgaagttgatgggtggttctacttgtttctgcaaagcacaagagcaaaaccctacttgaaccctttctttcttcgtcactgctcacaaacatcacaactatgtcgttgggaattcttcgatcgccagcgatttcattggcatcgaagcgattcctctgcaccaatgccgcttccgcacctctcccccctcctccttccgccgcttctcccagccgctggaacttcctcaaatacgccgtcgtcggcgctctcaccggaggcactgcctttgccggttacgcctcttacggttcgttttccttcatttccattttcagagtagtcatttagggttgatcgacagaatctagtaacatttttgtgtctgttttttttttttttcctttaagtcggtgttgtcactctgatgtgttagggttgttattgaatcattctgatctggaaatgacgttggttgaagatttttttttttttttggaatgaaacatgcagcttacagtttggaagaagtagaagagaaaacgaggtcgtttcgtgaatcggccaagtacgctgccggtgatggagccactgctctcgatgtcagtattgaatatttctcaggctttcttcactttcattcttctttgctaattctatgttttagaatcatattgggggtttaaatatctaacctgaattgggttgatgagctggtcattggaacgttgtttcttgttatatgaaatgctctgcacatgctatgaatttaacgtttacatttgttcaacaaatttacttttggctccatttcattgcttgtatcgtttgcgtgactgtttcgtcgccctacgtcaaaatatacagtggttttcttttattgattttgtaaaacactttagtgatatcggattaaatcctattattttgcttcgtggaaatgccctcagtggaccttacttttacttaatgttggattctgcctggttttgatatgataatgataagtttcttaagtttaatgtatagtaaggtgacatgttctagtccatatcttgtgcagaaatttcaaggtttgctatactcaactgcaatgacaggtgtgttccccgagctttattccgtacacacttatcctgtattactgttattatgttcccttaaataagttgtgcttttgtttcttcacgtgaacttttgttcccctgaagtgttgctgttatatgaataggaaaacttgagctcgtcatttagatggttctgtatttctgttttgtgattttatgaagtgctctttgttatcgataagcatggacatctttttaattttactcaactgaaaaatagtatgtaaaggtcccatggggaaaacactgtttccattagtattaagtgcgacaaatgctaaaattaatagtcattttcaaataaaccataggtctgcccaatcatagtcattatatgcccctacttttgctgcagaaaaatattgcaaatggatgagaatgtgggatataagcatgtttgttgccaccacctttggagggtagggggtagaaaaggaaagtgagcagtggcaagaacttgttgtattgtagatgttgaagaagatcagtgcagacaaattagcattgtatgcacttcttgggggtgggggtattcaactcccaattagttatatatatgcatgccttagacctctgttattaacatcatgctgattcttttgcatgtgataccccagtgcctgctaaagcagtagagctttatttggatgcaagaaggctaattgaagaacaagttagggtacgtgcttgctttttaatatgctgatattggttttgacacttgtcatttaaaataaattatatttccttcctttgttttaatactgttctcttttgcttttttttagagttatactgaaccatacacagacaagctccttcctgatttgcttcctcaggagcaacatgtgtttacacttgttcttgatctcaatgagacattgattcactatatttggacggtaagacgtctactgcaaattcacccttttttgttggtagaaatttgataaactcctcattattggttgaaattcatgttgggtgactaaatcagtagtaggagactaggagccactaaatagggagtaagactcatgaatttcaaccatcagtaaagaatgtgttgcttacattccactttcctttatgtactttatgtcataaaaaatccattggatctctttttgtcttgcttcttgctggaggtccttacatattatagaggtatgactacaatattgaattttacttttatggtatgtaaagcgagatacaggttggcagacttttaaaagacctggagttgatgccttcttggaacatttagctcagttctacgaaatagtggtgtacacagatgaacaaactatggtaatctgattcttctctatattctgaatggatacttactcgtataggtattcatattcatatattcttacatttgttgatttgtgcagtttgtagaccctgttatagaaaggctggataccaagcattgcattagatacaggctatcgaggccagctactaagtatcaggatgggaaacacttcagagtatgtgtttatgttcttacattattctcttccagaattaattatatacataaatacctgtggaaggagtacaaccaatcatggcaaataataagaacaagtgccttggaaatattatatttttatctataaaataatagcgaagtaattttgcttacacctgaagaatataaaataaaagacctatggttttattatgatacttgatacatcacatgcatagtgtactagtggtgttctggatatttttataatgagttgttctttcctttttccattgtttgcttggcaggacctctcaaaactaaacaggaatccaggaaaagttctttatttaagtggccatgctttggaaagttgcctacaacctgagaactgtctccctattaaggcttggcagcagcaagatatagatgacacagctcttttggattttataccatttcttgagtgtaagcattccttaagatatattgaagaatgagttattgtttgaattattgtttttattttcacatcactccttgagtgtaagtccattcccttaagatgtgtttataaatgaatttatgtttgaagttactgtggtgactttttatgcttgtaaaagttgcattaccttctctgttatctatttgcagttgttgcccgtagtagtccacctgatataagaccagtgctagcctcttaccaaggatgtgatattccaagtgagttcatcaggcgttccaaggagcatcaaaggtagtatttaatcttttacaaaccttgaagattataatattttcagtatttccttaactaaatttgaaaatacaaaatttcagtatagaatttgtgattataacaaaaacataattaataacaagagaacaagtgaaatgcgctcttaagggaatttggtttgtttcaattcagttatgttttcactgatagttatgagaatttagtgtttttactgagttcatattggtggttgaaggtttcttttgtgtatatagctgacgttacactaatgatttatcctgtgttgtgttcaacccacatttttactctgggtgtttccaaatgatgcaggagaatgcaagaacaaaaaaatcgtggttacttctggaaatgagattcaatttcattgcaagttgatacaaatgatctttgttgagggtagataatgagattgtctgtttcattacaagttgatcagtcagttcatccaagattttgaagtcactgcaagttgacaagtgattaaattaaatagagaaaatgtagattttgttttacgtaagtcttgcatctcatgtcttgaaccattttttcctttttgcctattgtaattctgttgctggaaagcacttgttaattttggggatggagttctcaatggatgtttcttgcgaggtgatttaaccttgagtacatctctgcgcagaagaggttatggatgaccataaactaaattgacatgataaaataatttacttgattttgttgtttattttgttggaattttctgttctgacgccttgatctaggtacagattcttgattttgggcattcattgttatacagtgacgtatataagctatatattattgattacatatatataaaattagagataagatctattactttactggtagaaaattataaaatcaacaattattttcctattaatatctttcttttttatataaagaaagtgttgatggaggggggagactagggtccttttttgcccccttgaatctgtccctaatccccagtatcacacgacacaaatgaaagccctttaattattaatgcaaaattatttatgaaatagatgaaaatgagattgaaatttaacttttaaatactaattttgtttaagcatattattctgttttatatataactttatataaaaatttcaaataaattaaattataaagtgattttgtggcatattttaatttcataatgagacaacctcactttttgtttaaatatagtttataaaggtaatggttaaccttacttctataagagaggcatttcctttgcaaataacatgacaatgatagtgctttcatattaatatcgacaagagtaagagcacgtcaggagtcatacatataaaaaaatcccttgcaagataaagagtgagcatcaaaattgatcatttgggggatacgtaacatagtaataacaagcatataaactaataatgaataattgtcatgtaattggtgcatcataatgctacagtctgagccactggtctccatctatgaagctcttgtacaggaaaggacttgcttccggatagctgaatgattttgaccaaggcaccctatgtcttctatctgctcctcttcccttgcattgatactctgcaaacactgcagtcctgaagtaccatatatgcttagacatattctgcactatgaattctagaatggaataataatgtcatatttaaaacatagagaaaaactagcaacaaactttactattggttagaatgtattggaaatcacaatttgtagtttctaatgaattttaaccaataatagagtgtgttaaaaatatatgttagaaattgagttattagtacttggagcaaataataatactatcatacttcttcctatgtgaatgattccagtctgaccacccttgaggattaataatgccatccatattacatttggagtatataattcttgagtagttcccccatgctctgccaaggtatacactgccagatcctctaatactgcaccctacaaaagaaaaacccgtgtcgtctgttggtgaatccctatgatgtgctgctattgctccatagttctcagctattgactgaagacgacacttctgctccatagttctcaaggatcagaattaaattcaataaacttggtcactagttttgttttagtaacagagaaaaaagttcatcttatatttacctcatagagtgattttgccctgccacagataaaatcaacttttcctatgatgcgacactttaagaagtaatgatttcctgtgttgtccaagagagtgtcctgtgttcccttaatcctcactcgatagaacattgcttttggactgcttaccctcagtgccactccttgcatcccttttccaccagccgatgcaatcactgagttctgcaaccatgcacccaaagattggcatttgacatagtccaaaatgcacatgccttgtgttggaattggatttagtgcagtcacttttccacacattcagtacatttataaccattgaatgaaaattggactgactcagatttttaaatgtgtgttttaagttgattgactgagagaaaataagagtcgtttaaggctgaatggtcattttggtatctgaaagtgtatagtgattctaagttagtccctgaattcgaataagttaaaaaaaaaaaaaaagaaatccctgaaaataacttcttacatttacataatttgttagtttcaaatgttatcattaaaatgcagtttatcccttatatgtagggactttgcattttaatgataccacgcaggatctatatgaaactaacaaattatgcgaatcataaaagctaatttcgggaactttttctacatttatttgaatctgtggggactaatttggaaccactgtcgtttaatcttcacccaatagttctgaaatgttgaatgtgttgaaaagtgaatgcagggaatccagggtaccaaaaattgtgtgtccttacctcaaaagtgatcccagttgcacagaaataatctgagtccactcccactgttgctgaagcataggtgcccaatgctgtgccatttgggcctttgtcagatgacttactgttccaagtaataataggacttgcagttcgatttcttttccctataaatgatacataaggcttggtcacaggcacacgcactttttctctgcacaaattgcatatacacaaaggataaaataacataagtcaagtttttaatgataaaaaaaaaaaaatgtaagttcaaggccttgatgactcatgaaattttaggaaaccaaataaatgtaactgttggatcaaaaacaccaaccaaacccagctccgttaccccaaaaacaaaaacaaaaaatgtattttttcaaaaatatggattaatcaaggcaaacaattaaaacaacttcttttgattagaactgaataataatgacacaatagaatctaattgttaatccatgtattttatcatcaacttgatgaattaattttaaaatataagattttttccattatagcagactgtttagaagaatttcctattttttcataaaatattttgctttttcctgatactcgggttcaaatatccatggattagatgtttgtttactggcttcatataattcagaaaaaaaggacaaaacttagattttggagttgttcttcgatcaaaatcagagtttcacctcaataattcaagttgacaatttaatcaaaatctttagcatatggattactgaaattgaaactccatttataataataaaacaacacccaaaaagtagtatgaaaaaatatgcagttaagtactgacctgtaaattcctggaaaaatgtaaattttgaccctttgtctgttattatcaggaaccagattcacagcaccttgaacagttttggaatgtcccccaccattctggttaacagttataacttgaacctggttatgggacgacttcacggccaacctttgttcatccacctgcaaatcttcccaactaatgtaatttcgaacagcaccaccttctgctaaatccaccacctgagcccaaatcacgaaaaccgaaacaacaaacaagaacaaaactctggaagacaccaaccccatcatcatcattattgcgttgccacgcaacgaataagaaactcagcatgaaggtttgtgtatgttaaaaactgttgatgatgtgttattattataggagcaaagtgggaaaaagaaactccaaaatgagaacaaaaagcttgtgttactgatgaatatagtagagtaacggttttagagttgaagcgtggagtagctgattgcaataaatatgcgagcgttatatatggtgataatatacatacgtctgttccaatcctgatatattaggcatgcatctgttgatgttgttattatatatgaattataaagaaggagagtaatagctaggaaaataaacgtggcttttgtttttttagtttaatagaagcaacataaaaaaatcttttttttcttgttttaagaaaagttgaataacttatgagacttgccaaatgcatcagtagaaatagaaagagtgttgagtaactgagagtgtatttatttttatagaagaagagcggttatagattcatggggtgcggatattgggtgcaactgccccccactatgctcttctctttgttttggtgaactggttttggatctttctctatgcatgcctttcaaatgttctttttttccctcctttgtgtatatactaagtgcaaaatactcatgaaggcatggaagttaactgtgaatattttttttttttacacagtgatttgttttaaaaaaaaaagataaatgcagtttgaagttaaaatgaaatgttataatggttactgatttttaatagttggagataaaaatgtcaaaaaaaaaaacaccaaatagagttattttctttatgatagttatagaatcataaactactatgttaattgtcaccacttgttcaattttaattttcgtttagcaaaaaattattttgacattttgaattaataatgctatgaatgatgagattttggacaatcttgaatgtttgattttcatctggtaatagatgcactatgagatagattttttaacttatggttcagctacttctaggattaatgcgaatatttaagtgtttcctgcagagaaaatgttcagttcatgataatgattttaatgaattaagaatgtggtccctcctaaacttttgtgtgggctgtgacaaagtgacacttaaaattattgcaattgttttgtatacctatacctatgagatgagacgatgggatcaaatacataaaatgcaagtgaaattatttcatcaatgtaaaaattaatagatatttatggtcgtggttgactttaatatattggaaaccattttaaattaacgtgtgttgagcaattgtcctttctcgatcggggagtggacacttatttgatttttgggtggtaattaacatattgagttatttaaaagttgatcagtccattcattattagttaattacattatattcatatcctataattttcaattaatatttaatcaattattgggttggattgcacataaagaaaatagattctaatagcgtgaatccatttctttaaagtggtagtgaggaacctccacctgctttattagaaaacataacaaatgatgggattgaaaataaggacaataaatgcagctattgtataatcatagaaagtggcggattaaaaaaaaaaatattaagtgagggttaaaaatattctgatattttctcaaataaaaaattatatgttttattaaaaatgataataaaaaaataaaaacaataaaatttaaaaggataattaggtaatggaattaattgtttcacaaaaatatttttttatttgaatatattaaataaatattttttactcctataaaaaaaaatagatgttgtcctcacacaataattttttaacaagataaatatgaatagttataaaagataaaaaaaaattgatattaattttatccactttagcttatatgtagatatgtcactaatcatagagagtttgtttgaatataaaattagaagtatttttgagagtttttatacgaaaaaaatactatattttcattaaaaactttaaaaaaaatatttctaacttgtattcaaatatatatatatatatatagagagagagagagagtatacaagagttagaatataaaaacataagtgcgctgaagagtgacgatagtgaatatcaccttaatttttacaacaccaaaaatcatttcaaattctcccttcattacagtccttggccatttaaggtaaaaacaattaataagcttcactcatgagtcacgagttgatggtgtcatgaatcataactctctcacacacacgcttccatcccccgttatattataggcaagaagttgttaggctcatagattcacagatatgaatttgcttcatttacttgttgtccaccgtttcacataagaaaaataaaggaattgcttattaagaacagtaaaaggctatggataaaggtaccggaaatgagagttagaaaatatcaaggaatgggaacttctgttttatttggttccggtgaagattcttggaattgtgcatgcacatatatatggaataaatttcatgttaataccgtgagaaatatacatttggtcatagaattatatacggatgtaaaattactatttaaaaagttttgaacaagtatcttataatttttatgactcaaatatagttttaaccaatctctatgactttcaaccaatgttattaatttttttttcatatataagttaaaaatttaaacatgtgtgacataaagattaattcgagaccattgacaagggatactctaagaccacataatgatttctccagcaaggagtctagattctttctggcccaaattcccctctagcaatatcttgcagcatctcagccccttcattgatcattgtacaacaattaaataagacagaatatagtgactggttttgattttaactaaagagaaatttttgatgaagatgcaggagaagaaccatattgcactaacggtgttaagcagtgatgcttaaacaagctttgtgcctaatagttgctcccaaataaacattgttcttatttagattagaacccatgtaataagcccaatggagacgtccttggactcatcccacatccaactcctgcaaatttcatctattgttgttataggaaaaagattagtgttttccaatctttacttaacacctatatagaaagagagaagagaaaatgatgtatatatgcgatatgatacaaagaaagacataagtattaattaaaatgtatactatgtgaagatgttcacttatcatcactcttaattttcaatatatctaatactatataataagagaacgaccttcttagccacaagtttcagtaaatattttccaactggatagactgggggttttgtgtaaggaatccagtaaacaaattgtcatcagattattaacaacaggagggctcaatagaggagaaagcattcacacattgatttttttttttttcgtctagattttcccgtgcaagaaattgaattttgatatgaaaagttaatttaaatataattacttaatatatttactataaaagaatactttgactctatatctaagaactttatataaaaattatattgacaagctctaagcatatcccccatttcaggttcttaaccatattgatcttggaaaatggaactactaaattaattaattaaacttgattaatctactttgttcatgcatatatcttgattcaggttcatagtatttttcttattcatgtatcttgcatttaataccatctagtttttaggagttgtgttgtttgaatgtatgtatgctgtaccaagaggtgccttgtacaatttagaaatactcacgtactagtgaatttgcatataagccaagaaaagaaaagaaaatccaggaaatcggatgaagtgagtttgtaagaaaagtttgtgtgttctccctttcccttctctacttatgttcttgttgtttccttcaattgaaattgagctttgacatagtagcagtcaagaaatacaaatcattaacagaaattataatattgtgtatatttcactgcaaatgaatcttttttttttttcctggccttttgtcattaacagatatattataagtataccatatacagttatttaattctgaatttttgtacattttttttcctagtaaattatgctcatggagttattttaattggtttgaaagttatgcacgatgttgttctttatgcttagtttagaaaagaactgttataactgtcaagctttttgatcctttgccaatatattttggtgaatactggctattgttcctagtggggtctccctaatacattctacacctcagttattgctggagcactattttcttgaatttatttgactatgttttgctctcctggctgcataagctttctttcaagaattttttatttttttaatcttgaagtagaacctctattttcttgaatttttttatcctctatcaaggctttttaactggaaaagactagtaactttaaatattgggcatatatagattttgggatttattcgagacatggagtaaccatattacacaacaatcaacaagatcaaatatgcacagttttggtggttattggtacaacatcttcaataatgcagaaatcagatttacttggctaggcatgaaatgctgatataaaaatacgaacctgtttaaatataggttaaaagtgtttttgagaatttctctattgaaaatataatatttttttaataaaaaaaactctcaaaaatatttctaatcttgaattcaaacaaactctaagaataacaattatttatcactttccaataataagaagagtatataatttttgcatgccataaaactcataatgtgtttggcaacatttttcacttagttcagagtttattttactagataaaaagtttctttaggcaaaaagcatgtatttggtaaaataacttattttaatagtttctgatgaattttttcctcaaatgctacctaaagtcacttttatattatgttttttaattattaaatataattcattttaaaaactaaaaataaactaaacacaaataattacaactaaaagttaaaatctcaagtaaattaaaatatgagaaatagaagtgcaatcaaacttttatataaaccagccttgtaggaaccagacaagtgtgtctcgactgccatgtttggtctaaaagaaatattaattttttaggtcctttactttacaatgtcaacaatacagttatctttagaatacacaagtttaattataaaaaatattttcgaagagctcagatatcaatcatacgcgaaagataccccttttttgtaaacagtttaattatgtgccatatgatacaaaaacaacttaaacaaagaataaagactcgcacgggacaagatatatatgatataaaatagatattgccagacataataaatagtgaaatatttgactacatttaatatagaaaaaagagttatacattgaaaatttagtaaaaaaattgaataatcattcaatgacaaatttattaatttttaaaataattatcttaaaataatttaacaataatttataattaaatattaataaaactattttaaaatacataaacattaaactctttaatatacctatacatatttaatagtacaacaaattacactaacatctaatttttttaagagtctaatgataatgaacttgtagtataaaataatatatagtcattttaacacaaattatttaataatttatgattatatcatagtgtaattaaatattttttattttagaaaataacagtgtcaatataatgtatttcaaataattaacataaactattgtaataatggttaaaaaatataaatgttttatgcggtttcaagaaattataagatgtcgctgtaattttctctttggtgttaatatctatttagagacgataacattcgcaatccataattctctagcactacaatattttcctttttactgttttggaaataaatctcgtgatctttcaccttttttccctatactataggtatcttctacaaaattaataggaaatcattcttattaaacaagttttttttttcacatgtaaaactcaaatttcgggaccttaaaaattaagcatatactacttaaatcaaccactcgttagtatgtataaattttcattttatctacattgataatagatattaattacaaaaacattcattctctcgtgtatgttaaaatcaccgctaatcaaataataaaatgttataaatatagattatagagtagtttatatactctttaatatgtatatattggaggtggctaagcccaaggagcatgaatgtgttgaagctatgataatggtgatgtcatgggttacatgggaataggaatgacgagggatgggaattgggtggtaatgtatattttgaaacaatttgactcaatgaaaccaaaggtggacttttccttttacaaaactggcaggttctaagactttcaacatataattaaataattcgcctttataaaatcaaatcatttcttagagtgaaataaatttattatattgtttttattcttaatgcatgtaattttattattgaaattattttatgctttccaaaaaaaaaagttaatcagtttaatttatgtatttccccccttttttatacgtcaaaagaatatatttttaactttatttaatattaacttgttaagatattatttttatttcttactctctaatacctatattctcaaattaattacttttgtgtgtactatattcttctaagaataatttactaatttagtctctttgtaaaattccctacaaaaaattgacacgtaattttgtgtttctaaatttaatttttgaaatttattcatacttacttttttttataatctttcatattttattacgtgtttcaaagattaatctacatgaattgcatttatacgtttttcataatgttaaatatttctcttaaataacttttagtttatattttgaaaattgaattaaatttagacatgttcttataatacacaaaatattttatagttataattgttgtcaaggaaaatactaatataacagttaatacgtatatcatacattacgtacattggagtttttaaacttccgtaattttttttttgaaatgatcaaaacgaagattaattaaaaaaacttaaaactatagttgtaatatgcatacctaatttataattattcatagaagaatactttaagaatttaattatatatatatatatatattattaaaacgaaataatagttactagataaatctattattatattatatattataatacataacttaattagaggtaggacttttactcactctcactttcttaattaattttttttaccaattaattaatttttttaatattaactttctttgtcttttagacgtgcatttacagcattgctcaaataataataaaaatttcttccaactatctcaaattactttttttagcctttcgtatgtatttcatctttttaggtgtaatttttttttcttatcttggtgtctaaattaaatttaaataattaattcaattatcaacatttaaaaaactgtgataatttaagttatttattatatgtttaagaatatttatttgttaaacttagaaaatataaattttgttaatatatggtgcatagaaagatattattagttattagtagggacaaacaaaaactgtatctttgacaatccatcaatgataaacgtttctttcaccttatataatgatggtgcatgcattttttctctttaaaaaaattgatattgtaattggaatctggtctcttggatctccataaccttcaacgtttcttcccttagattaggggcacatatcacatatcattccttccaaatcttctcctgaaaacaaaaccatgatgagaaggcattcccttgtgactgcatcaccaaaacaagggtccctcttctttgttggcgacgacgacaacaacatcaacccaagaattcatcctcacactcacacccttctgactccatcatcaaaacaagtcacagaaaaccataatcactccaaaaccttcaaaaccagtttcaatcacaacagggtaaacaccttgcacactggttccaccgtacaacatgttgaagcggatgaggccgttgaactggatgtgttgtggacgaagatgcaggaagaagccaaactcgatgtcactgtggaacccattttgtcttattactacaacacttccattctctctcaaaactcactgcaaaccgcgttggccaatcaccttgccatcaaactcagcaactcaagcctcccaagcagcacactttatgatctttttgtgacggttttggagaccgataaatccatcatggatgctgtgaagagtgatctgagagcggtgaaggagagagaccctgcttgcataagccacgtgcactgcttcttgaacttcaaaggctttctggcgtgccaggctcacagggtggctcacaagctatggtttcagggaaggaagattcttgctatgatgattcagaaccgggtttcccaggttttcgcagtggatgttcatccgggggctaggattagaagtgggattttgttggatcatgcgactgggattgtggtgggagagactgctgtgatagggaacaatgtttcaattctgcatagtgtcactttgggagggactggtaaggtttctggggacaggcacccaaagattggtgataggtgctgattggtgctggaacttgtatcttggggaatattaaggttggtgatggggctaagattggtgctggttctgcggttattaaggatgttcctccaaggactactgttgtcgggaacccggctaagctggtaggagggaagaacaaccctgttaagttggataagattcatagcttcaccatggaccatacttcccatattgctgacttttatgattattgtgtttagactttagagtgtagcgtaatgtaataatcctcaagcatgtatgatttggagttttgtgtttaggattttaggtgaagtgattttgatttttgattggggctgttcttttttactatttgagtgtgtacaatagcagcaatgagatttgaacctaggacttcatgtagactactcaaatctcttaaccactaggccaactctggtggctactggtgctgttcttgtttgagtaatagagaattcatgttctcctgctaacaataataaaagcgaaaataatagtaacagcctaacaggaccccttgattacatgatgttattgttgggtatgtacagaagctgtatttgtgtatgtatgcatgattgtgttgttgtaagttgctgtatatgaatttcggttttcattgctttcattatctattcttcttcttgttatgttgcttttccttgttggagattaatgtgtgagtggtagtctcactgggctgtagtttaataaaattaatgtagattgtaggccatgaagatatatattggatggtatgcaccttaataagggtagtgctgataggcttttcagtcgtgcatccagtgctgttctcagtttgagcactcgatcgtttggaatttataattttatgattgttcaaatttccattttttttaatataaaagtccaagactgggtgttataagaataagaaaagccagttctttcaatcatcaacatcaaaccatctttgcaagagcttaggcaacatcaaattcttatccctgctaagttgtttttatttctagttatcgtggtctgaggtattttttcagaggtagaacaaaggaattactctttcagacctgtacttttatgtgttggtttatcatagtttttgtaatctaacatgtcctcttaagcaagagcagaagctcttcaaattaaaagcatagactaataaacaatgcacaagcttatttcatgttgttctaattttaaagatgaagttcttgtggggaagttattaaattgctaagcatctaaaatttgaaggaagatatatgaacaacactgaaacggatataaaattaacacaaatttttcaatttttttgaagtaacacaattttgacttagtcccttcctggggcaattttggctttcactatgtttggtaaaaggatttgatggtgtatgcaagtgcatggtatttggacaagtaacagatggacatggttggggtacagactcgccgcattggaagtccaaagtttctaactgctagtctttaggggaatgtactgcataaaaagcttgtcatcctatgaaagccaatttcatgacggaacatgataaacaagcaacaaaatggctaatagaaattctgaatgttgcaggccaaatacaaatggttaagataatatgaatattcttgtattaacttaatcacagctacgaacactggtatgaacaattggtacacaatgctacaagatccttcatgtttatgttattaaccaaatgtgcactgttttcagaaaatatgattttatacctactatggtatttcttcaaaaagtatatttatttaggaaaaaataaaaggaaaatggatggttttataggttgtttgattgtatacttaagtggaaggaaagaaaacaaatgtatataaaatgacgcgaataatataaataaataaataaataaaaatgtataagaaatgaggatttttttttaaaatatttttttttctttaacccatatatatttcatgggtagaataggtctacttaggctaacaagcttataattctttttttacaagtcttatcataaaatatacttttaaacatgaagattagactagatcttaaaaaatgcggctaataaataaatatgttagattcagactttgtttatgtaataaaagtcacttttagacctatcaaaacatatttggtgtaatctattttcatctctattacaaactttttataaaacaaatacatcttatatcacttataaaagtttttttttttgctaacatattacttataaaagttttaaaaaatattagataatgttaaatatctattaaatataagggatataaatataatatttttcttttgtttttgattttatgagttttcattttaatagattgatatagagatttgcaatagttttaaacagtcttaattgtgatgcaatttaatttagttttacataaaaaatcatttgaactaaacatacaactcattcaatttgatttgaatgtaatatccaatttgaaccaagtaaaactattttttaaaacttgtttatgtttttttttccttattttcttaaatttattttatgtttgactttaaaatatttctaattagacaaatagcaacacaatttgatacggcgtaaaatatataattttattattaagtaatgatcaactattaaaaataacgtttaatttttatcaattatttgtaaaaaaatatatttactaatatgaatctaatgaagaaaaaaaaatcagagacctagttaaaaatttagtaaaaaaagatgagacctgcgggtcaatttaactattttttatgtgatcagttttctatttatttatttatgaatttagcactttaaaataattatttgttgagacttgagatattttcttgcaaaatatacaaggagtgatttgcaatttgtataaacttgtcatgtgacccattgtgcaagtaattgagggggattcataatcatttgtatcgaagaaagaagcgacccaaattcgaagaactttgcttccttcaaacttcaaagtgagatacggggctcaagatcaagaacttcaacctcaacctcccttctctgtcactgtgactttcgtttcgtatcgttttattattatttttaattatcctactttctctttctctcttctcattatgtattcaaaaccctagctaggtttttggagctccctttctttccgatcccaccgtcaaacttctctttctatatgttttgcagggtccattgaatatgtctccgtcgttggatcttcctcccaagggtggcttcagttttgatctatgccgaagaaacgcaatgcttcaaaacaagggcctcaaagccccaacctttctcaaaactggcaccactattgtcggtttagttttccaggtctgaaatcattccctcgctcttttcatgtctagttaacctaattttttcttattattatatatttaaacatcgctgggtttttatttgtttttctacgtgtttatcttcactcttttttatctgcttctttattttgatttttttataccgtaattgtgagtgggttccaatggaataatggatccagacacatgatgtgaagttatggttctgcttggaatctcgaatgaattagataatttgttttggtagatagatgtctggccttgtgaggtttcgctgtgcgggtgaaggaaattcaccttatgtaaatgctataagttttgggtgttatatttgcgtaggttgcgaatgttgaatttttatttatttatttttatgttagggaaatagttggttctgaaattgtgcattgttttatagcaagagaatatgggaagcctagtctggctctggatatcttgacttgtatgttttgaaaatctacgtgactgtttttgaactcaatttctatctgtaaagtagtaatattagtctattactactctctcttttctctgagaaatttgattgattttttattctaaaaatattttaagtaaaatgttaatttttgttctaaagtatatgaatgattttactttagaaacaattggcaagaaataaagtcataaagctcctgcattgatttataaattttgtaatatataagtggctacttcagtaactgctaatcatattgacctcaacggtggatattgagcatggttaagcttttttcttgtctacattgttccatctagctggggaacaatcaacgtggttgtgattctaatgttacagctgaggtttaatatgaagattttgtatcataaatttgaaaccaagttgctccgtctacagagtacagactgatttcttgtgaaacagtccactaactgggaattgtaacatttgtatttgtgctgttaatgagacttttcatggcaatattatctattccaaacaaagttttatgacttcatatgttgattgcatatttatttttaatgtttaatttgtatattgtaatctaaagctgaactttcccacttaataaatctgcctcaggatggtgtcattcttggtgctgatactagggcaactgaaggacctatagtggctgataaaaactgtgagaaaattcattatatggcacccaacatatattgctgtggagcaggcacagctgctgatacagaggctgtaacaggtatttgtttaaaatgcatttttcttgttagttgttacacatttttacgttatgccttatggatagttgcatatggaccacaactttagcttttgctcttgttattattgatgtagtaaaattgttgaaaatgagaagtttgttatttactgtagacatggttagctcacagctgcaattacatcgctaccatactggtcgagaatcaagagttgttacagcactgacccttcttaagaaacaccttttcaagttgagtttcagaattttctcatcaatttaattttctctctgtatcaaccactgaatctgactcttttaaactattgtgcagttatcaagggcatgtctcagctgctttggtgcttggtggggttgatatcactggacctcatttgcatactgttagttcattgcttaaaacttttcttttatgctcaagtttccttgttttggatgcctatagctcaatttctcatgacttgttttgcagatttatcctcatgggtcaactgacaccctcccatttgctacaatgggatcaggttcacttgctgcaatgtctgtatttgagtccaagtacaaggaaagtttgagtgtaagtaagaatttaaggctcacagcctcatacgttagtaaagctctacgttagagtatttttgaggaaattcacccttagaggagtgcatttgatacattgttgtgaaatggaggtgccatggcgcgatgggttttgctaactgcctactatttgtgaagggaggcctgccatggctgtgccatagaccacaatggcatgcttatatggcagaattcttgccttccaccattgataacactgatttgataatattctgtcaaagctgttcaatttataataatttcaatggaacaatatgaagcaaatatgtcaatttcaaatctaaatgtaaaaattgtgcattatatttgttataattgatactggtggtgtttgtaactttttatcatgttgaaatgctgcattttgatagagattttaatttgatataaacattatgatgtggtgtagagggatgaaggcattaagatagttgttgaggcgatatgcgctggaatatttaatgacctaggaagtggaagtaatgttgatgtttgtgtgataaccaaggtgagtgctttgatgatcaattgtacaggttgttctttgatgagagtcatctaactctaatttctgcacaatttcttcattaatgcttcacagggacacaaggaatatctcaggaaccaccttctaccaaatcctcgtacctatgtcaatccaaaaggctttgatttccccaaaaagacaggttagttgcgatttttgctaatttaatatacttgagactgcaataaaactatattgttttgcttagtattgtgtgtcaaccgtcaatagtttgtagtctagcatgacattgtatctcaccttgtgacaaatatgataatcttgggaatttggtgttgtgaagtatcaaacttagataatagctcaagttagacaagcccctttcaacttgttgctatatgattaaataattgacgtttgacagagttgtcaatttgacgttcatgtttttctgattaaagaatatgttagatgagtacttattaactaagggttgagatgagtgctctattaaatgagggttgtgtgttactgtgtggatgagttttgggtcttaaagacccaatccatgaaacacaaatatgattatctctttccttttgaagttcctataacaaatctactccacttattattgttgttgtttaacacaatgttacacaaatacacaaggctacatatagtagaggctgtatgcacattaccatgcatgatgcatgtcatatacacaattccgttaactatttaaattaatagttattaaggggattacttatgctgtcttacaatttaggggtttgattgcttcaattggaagcacaaggaggcaaattgcacataatcctaagttgaggagtctttgtataatttttcctagataatatacatccatgacatttttatataaagcagaattcctattgagggcttgagaaaataattaaacctttaatggcctgccctttctgtgtctgcccatatctcctgtttcctttttttttttttttaattctagctgattaaacagtatggagaaaattcctttatagaaattattttacatactgtactaatatacattctccattgcagaggtcctcttaacaaagattaccccgttgaaggagaaggtggaagtaattgagggagatgttatggaagagtaacaatcgttccaaaaaatatttggtgtttgagtatgaaacttgattagtgcaatggctgtgatatttagttattgtagtttcacaactttggctttcattaccaaaaaatatttgaagttaattagattgttgcaagttattcctcaaatttcttcatctggttggattttgactagaaaatgcttaacaaaacatcaaatatatacaatttgattgatgaaagatgttacttgttttgttttgacttttcaagctttatataaatataaattggtctataatgagattaactttgttagtaaattgacaatttcgacaggcgtacttgctagcaagttgacaactttaggaatcaatctgtgtaagggaggggttttatgtacagttgaaatactatgccacaatctgtgttgacagttagttttgagtcttttgacaatagagtggttttatatttgtgaaaaaaattattgtttgagcgagattaaatttgtgaaaaaaatggagattaaattcatcaaattaacatagtggaaagaacaaaagtataataaagttattgtttgagcgagatttagagtgtaaaaaccattatctttgttttttttttttttttataaaaaaagagtgtaaataccatcagaactttttttaatgcaatactattagaacttctgttattgttttagtagatcatttctttcaattaataacattttaatgttaatttataaatattttgaaaactaacattatttacaaaaatagagtattgtataaataatggtatttcaattgaatgtttaattaaagtaaaacttaattttaaaaatttggtcattcaacatttatttatttatgatgaattctaaaataatttgccatttgatatatgcatgagtattatataagaaattttaaatattgctaacaaataaattaaatctttggttaattgtaacttttctaatttaactcaactaaagttttgaaccctaactttattattttttctattaaatacatttatatgatgatgttatgttttgtaattaacattatcaatttatctatcaatgtttcagtacattatatttgacattatcgaatcttactacatatgatttttacaaatgaatatttacattacacacttttaaaatgtataaccaacctaattaaaaactctaattttattttttgtgttccttaactacatctatttgatgttcatatgttttgtaattaacattataaacttatgttacaaggtttgcatgttatatttcatatttatgaattttattatattttcttttttcacctccaattttacataacatgataatgtgcatttaaatgtataactaatctatgtatatgcgcacgggtcaaatactagtttaaactcaaataaaaaaatgaattttttaatatttactacatttttataacttattttgtgcattataattataataaaagtatttttataattataattaaattttttatatcattatcatgagctccctatatagagccccaacaacaagacacgtgccaacatcattaggctgacaaaaccaacatccaataaggctcgacactcttgagaagcataagctgatgaagtaatcattttgtccaccaccagtttgctatcaaattcaaagaatagatctatgagacccatctaaatagcaagagcttcaacttcttcaacgtcacttctattggaatcacagatggacaccacttctgatcaaattatatgggtttttttccattaatttatttatcaaggactatcaatcattgattgaatcgatgaagctcctatttgttttagtatttacaaattattttttcatacttttttaattaaaaacatgttttatgataagtttatagttaagatcaatttaaataggtacatgcatcttaattatacttaacagttcaaaattaatttaattaaaatcattttctttctaacttttttataaaaaaactaacccagaatttaatgtttacaaaaaattattcaaccaagcaattaagttcaataatactaattcaagaagtaagtaaataaatctttttctaatgattatattttaaactattatattacaaattatcatttatcttaaatatatatacacagtatcataagaattaagattataatctctgttcatttcgaagaactaatctaatgactatatagataaacctcagcatcgaaaattaaacgtatggccaagagtcgtgcttgcagccatttttgaaatattaattgtcgacgacttttctaaccattatctttgttaatttctaattaaaaatcagtccattttctcataagctaagaaagcagcagcagccgcaccagtaccagctatatttcctcgtttcagcaccaagctgtgaatttgtggtttaaacctcaacattacttcacagccaaaccatactttttcaaggttataatcttgatttataagaatggggttggagcttcatatttccttatctataatccttcctttcttcctcttagtgttcatgctaatcaacacactttggagatcaaagaccaagaattcaaactccaagttgccaccaggaccaaggaagctacccctcataggaagcatacatcatcttggaactctacctcataggtccttagcaagattggcaagtcaatatggttctctcatgcatatgcagcttggtgagctttgctgcatagtggtatcttcgcccgaaatggcaaaagaagtgatgaacacacatgatatcatctttgcgaataggccttatgtgcttactgctgatgttatcacttatggctctaagggcatgaccttcagcccacaaggaacttatttgaagcagatgagaaagatttgcaccatggaactactagcacaaaagcgtgtccagtccttcagatcaatcagggaacaagagttgtcaatttttgtcaaagagatatctttgagtgaagggtcaccaattaatatcagtgagaagattagttcattggcatatgggttactatcacggattgcttttggtaaaaagtccaaagaccaacaggcttatatagagcatatgaaggatgtcattgagacagttacagggttttctcttgctgatttgtatccttccattggacttctacaagttcttactgggattaggactagaattgagaagatccatcgaggaatggataggatacttgagaacattgttagggatcacagagaaaaaactttggacacaaaggctgttggtgaagaaaaaggggaagatctagtggatgttcttttaaggcttcagaagaatggtgaactccaacaccccctgtctgacactgttgtcaaagcaaccattttggtcagtatgtttcttaaaaatctatgcaaaaggcaaagataattatatccaatcaaatagttctaggtatgatttttttcttctctcaattgatgatttgatgcagtcaaaataggattgattatattgatcttgaacatcttttacaagagaaatgttaatgacaaattctctaatacaatattttgaacacactttttatttactgaaatttattaaaattacatatttgtaggtcatacttcttatttattagccttatttatgattttacaatttttaataaattttaactagtaatagaaagtatgtcaaaaaggctgcatgttgctaaacaggccagagaggatccgaacttgataggagtgcgttagaaagagtgtatcaaagcaatcttattgtttaatattttacatataaaaaaccgtccaaaatttccaaatctgagtcatttagtagactacctcatcagtcatcaagagctgtcctgggtgcacttcatattttaatttatatggagttatgtaatgaatattgatctaatgttttgaactgagccggttttaagttattcacacttaaactatgacttacattaaattaaactgataaatttctttctatgataaattctggttattattgattaatctcattagaaacgtaatactaacaccttaacatttctgtcaggacattttcagtgctggaagcgactcttcatcaacaataattgtttgggtaatgtcagaactagtgaagaacccgagggtgatggagaaagtgcaaattgaggtaagaagggtctttgatggaaaaggatatgtggatgaaacaagtattcatgaactgaaatacttgagatcagttatcaaagaaactttgcgtttacatccaccttctccattgctgcttccaagggaatgcagtgagagatgtgagattaatgggtatgagataccaaccaaaagcaaaatcattgttaatgcatgggcaattgggagggatcctaactattgggttgatgctgagaaatttattcctgaaaggttccttgatagcccatttgattacaaaggtggtgattttgagtttatcccatttggagctggaagaaggatatgccctggcatcaatcttggcatggttaatgttgaattctcacttgcaaatttgcttttccattttgactggaaaatggctcaagggaataggcctgaggaacttgatatgactgaatcctttggcttgacagtaaaaagaaaacaggatttgcagttgattcctatcacttaccacacagctacaagttaaggccataactattgtgttattaaaatgaggttgctctcaaacattataatagcatggatttctttttttttttttttttttcttgtgtgtgaatggagcatggatttcatttgattgttgactacatcaatttgttagccaaactaactagtctcaatctatatcaccatatagattacaatttgtttgtcaaactaagtcaatagtcaagaactctatgctagtcaaatatttgaaatttgtgttgtgtacttattattagggtgttgtgtacttatcattaagcattacccataataacacctatttgaaattttttatatctaaattgttgcagattttaatatgaaatatttttttatatgattttctaggtagattttatttttatatctgataaagtatctttaaatgcatgattataaaactaattcttttaaggatgatggtcaaataaagttattttcaaaacaacaattcttgaattcttaatattgaaaggaaagtttatataaagtcataattcattatggtggttattaaaaaaatcattttcattaaaattatagataccattaagaaaataatttgaagaaataattaatataaaattttgaaatttctatattttgagaatatttttaaattcaaagacatgtatttttcttcatttcaaagaatcactcttaggtaaataatataataatattaatgatattatattttattcaaaatatgtatttaaagattgactttgatttgaagcacatgtattttttaccattggaaaaagtttgtatctccattatgaaataaaataatttatagataaaaaataaaatttgttatatataatttatttgactaattgaattagtaatattttaaaatgatcctattctaactaatataatattctggtaatattcaatttttatgatattatagaataaacatattatttatttttgtatttgtatatagtatttcttttaaaaactatccaaatttcaattttggtactttgcgacaagacaaaacaaaaagtatatgaagtcaaaagaaatactctatttaatagatagattgtgaaaaactctgtgtatatattttcatataaatatgcaccatgttacaaagttaccaaatattttagtcaataattaatatttgtacttgattttatttaattttgactaaaaattttaaattttctatgtactatatatttcctatagatcttatagttttaaataaattaaaaaaataatcttaaaaattacttaatagagattggttgacttaaatttaaaatcttattatctaaatttggaattaagataattttatactatatcattcgtatctttagaacatataatttgaccattgtgtaaaataatttactttaaaaattagtttagtttgatatcatgctaacttttgctatattttaaacataaaagacaaaaaaatccccagcagatgagacataagtattcgttgttggttttttaaattagcaaacaaatatcattaacttggtaccagtggtacccaaataaaaaacatattacaaaaagagaatatccaacttgaagcaatgaggttaagctgtattaatatcaactaacataggaatatttattaacctcaagctaacagcctgaacatctcaaggaatctgcatatttctatatcagaaaattatacccaccccagataacatatcccttctcctgttacaaaaaactctgcaccttagccttacccattgcaacccaaaacacaacaccacaatgttgatctcgagtgtataaccctcggcccaactcaccaaagcattccgattaggcacaaagaaggcaagtgggagtgttgctactccactggacaaaacaacaagtaaagcctggtgtcaatgatctcaaccatgaccaaacacagaagttaacatcctgtaccatatcagaactttgagcagaatctatattaaaaacaaggttattccttttcttccagacacaaaaaattactgcactccatataaccatccatatattgcattcagctgaagaccttccaatgcccgagtggagccaaaaatgatcttgaagtgatttcggtaaagctagagcaaaacctggcgaaatccaactgtgacattctaaccagattttaaacacagcttcacagtttaagagtatatgctgcatggtttccacttgttgattacagagtggacacatcaactcagcttcatctgtgataattcccctcttccacgagttatctttagttgggaagcctatctctcaatgctctccagattaaaaatgcaactttccttggtatatttatccgccatacctctgctaaggtgatatgcagggcctctgagccaccatctagtgttcattgtgaatatgcagaatttgtagattaagtgcccaaagggcttgctctccaaatccaagaatcaacaatgttgttatgcgcctgcacagtttccaaaagagttgttagttgtaaaaacatctccctctcccactcaaaaggctctcttcaccaaaaactcccaagaccatatgccattcctccaaactcccatattcccgatcagctccaacttttgttccgagattaagaataaccttggaaactagtttgccaacaatttccatccacccaagtatcaacccaaaatctcactatatccccgattcctattttccactggatcccattatcaaaccatttttcttgattaagccccctacacaccctctttaagtccctccaccacaagctttccaacgaagagctatcctcactcaagagaccacaccacccatcatattttgacttaagtacatcaccccatatccctttttgattgtgaaagagattctacctccacttctccaaaagaatctcattgaacaactcaatctttttgacaccaagacctcccttcttctttgacaaatatcattccatttcacccaagctaatttattaatatcattactccctccccacaaaaaccgtctttgtattccaacaagtttagcgcacactaccgtaggaattttgaaaaaggagaggaaaaatagttatatggatgataggatggaatttatcaaacaaaccctctcccaagagaaatatgtttatgcttccacaacgttaaactcttcttaaatttgtgattaaccagttgccacgactcctatattggaaaagaagatatttgagaaaatgaaaattttaaaaagatttggaggaagaaaatattttattattatacaactcgttttatctattggcttgatagaaaatagtggaaaactttcatagttatactaataatacctccttaattaataagtaggattctgctaacacaattctcatctaatgactataaatcattatctagaattctccacactattttagcttaaatatttatgattgtgatttctagatacaattattctttagatatttttatgaaaatatctagagtaaattattctaaattttagactaaacatctcttgaatatttttagatattaaacaatttaacaactaagttcaatatacctaaaccaaatttattattattcaacatcctctaacctaagattagtcccgatcagtaatccttgataaacaatcagtaaagaaaggattctataatttaacatacttacacaccactccttcacctcatccgccaaaccaatggatatttggagacataagtgttagtactaatggatatttgaagtttcaagaacatctatcatcactcaatatgtgataaatcctagtagtatatagggctaaaatctcgtgtattttttttttctattcacatgaatttcacttaaaaaggtataaactcctttgaaaatgaaagacaaaaacggaacttaccgaaatgcagaaaagaagagtataaaaatattagtcaaattaaaagcaatgtgaattaatgcatgatcatatatttatttatttgtttttgaccaaatgcatgagtatattagtcattccaattgggtgtgaacacacactgtgtttactcactaggaatgcgtccttttagcttaccgaaactgaaaaggtgtattggtcttatttgacatacagacacaaaactttactcattcaaatcctttttattttcataggcttcaaaactggctttggtttttgttcagtaaggccttccctattcctgtgctactcacttcatcttcttactctccctaccttgaaaaaacgtgttttttttttttttatcattgtgacatagaaagcgtagcgtagtacgttcaaatctcacttcttcttacgttccttcattctctgatactgataagaaagtctcattctgccactgattttttctttctatctttttcacaggaactttacttgtagcaagcaattgtaacgcaagcttcttccttgcccattcccccccaaagtttgcgacttttgagattctcatggccttccaactcaaactcgaacctaggtctccgcctatgtccacttccaccacccagaaaaactacaaagagatgagcatttctcagcttgtctcggttttgcgtgtttcgtttcaaacggaggattttgacaaagttgaggaagaattggcgaacagggacgccaaatttaaggcggagattgagccactccgggagaagatcgaggtggagaggctcaagaggattgaagccgaagaaaaacttaaaaatagagatgagcaatgcgaaaaggggaaaagagcacagcaaaactatgagcagttgttgaaggaagtgaagaaaaatggtttggttgaaaaaaacatgattgacgagttaagaaaaatgagcctcgctttacaacgtgaaaattgtgagctgaagggcttaaaggaaaaatggctagatgaacttaggagcaagatcagtgtgttggaggaggagaaggatggggacaagagtgttcttgatgcccttagcacaaagaacagtgaattggaggaatcgataaagaagaatttgacagacatagagaggttaaggaaaaagaatctttctctagaatgtgaagtctgtgagctgaaggaattaaagaaaaaatggctagatgatgtggctgaacttaggagcaagattcatgttttggagggggagaaggttggggagaagagtgctcttgatgcccttagcacaaagaacagtgaattgaaggaagcaatcaagattaaattgaccgccatagaggggttgaggaccgaaaatggtaaattggcagatgagaagtgcagacttgagacattgatggagaatttagagagtaaatttgcggaaatcggtgtcaggattgtgaagttggaagatgctacacagtctttgttagattgcttaaaagctgaaggaattactgtcaaagttgaagaggttggtgactacgagcttgaaaatgacactgggggccatgttcctttccaaaggaatgaagatactcgtcactcaattgatgctcagtctcgtagcaaagggaataaggatgctctaggtgcatcaggtatggaattctgcttgcatcaggtatggttcaaggcccagctaccaagaaatatgaacaaaaaaaatgcatcaagaattagatttgcatttttataatgcattttgttcatatttcttggtagctgagccttgaaccatgatgattatttattggtaatggctgtggtcaagagccatgttttagtaacttaattgagccggtggggccattaattattgctcaaattggatgaattggtgactgaaccagatcacattaaaatacttaaaagctcatcacagtttgcaattataattagacacaatttaagaacatacactcctcacagcatccaatcttgtttttgaagtgaaaatgtcacagttccccataagtttcaagtttgattgaccatgtttacacaatgaatttattaatttggagaatagcctaaggtgtctacttgcaaatgcaaggtaaggctgcccacaattgatccacactgtaggtcagacacttccttggacccccacacagggagctttatagcaccaaattacccgttttcagcctaaagtgtctacttgtgaaaagaagcctaaggtcaattttcctttgttatctcaagtaaaacacagtattgttcctgttgtcttcctttgatgttagacacatggtttgatttggagagtcctattatatttttgttcccttagaaaactgcaagccatctcttgtgatttttttcttttttcccctgataaaattttctttcgatgagaacaaaagaaagaacaaataaaagcaggcaagataacttgtttctcccatacaaacaagattacatgatacccttctatacatattatatgaatttgataaaagtatacattgttaatcacttgaagagcttgaggctggattttcatcaaatgctgaggcaacaaccagtttctatttgtattacagaatctactaatctttattctcctagcttttgcttgaattatcatgttaacaaaaataaattttatgtaagttttaacatatctcttttgtgcctgcagggttcaaattggaatgggaaaataagatcataaacctagatgatgatgatgatgatgatgatgatgatggtgatgggtgtacatcaaaaggattgcatggaaagaaagccatttctcaaattattgcagaaaatgaacatccaagttcatcgtatgcaatccagcacaaaagcatttttacagaagcacaaaggattgaagaaatcaaaacaaaatatttatctgatatgcagaattctacttccacatcttctgatgatgatgattcatttgagtttgacgaaggtaatcctcccaagagaagaaaaactgcgccagacagttctggagtaaactctttgccaaggtaaatggagcaatgagctatgttaaatatccttagccatatacccttttgtgtggttatattgaaaacaactaactcagtcttttgtttgtccagttacttcctcactcgcaaaatctagagcaggaggttcccagccaatcttatatgcagaagtttagattagtgcttagttttaaaagtattcacatgttggaatcgtatattgcagatatggtagtcacagtatgtttgtatttattaaatgtactttatttaactgataaattctatgttacctaatatatgtgtttatgtatggatgcataacgagatatgtagagaaactgtgcattccaatatctagtaacgtccatatctttgcttaccttagattcctctcagtgattaaaggtctattgaattttgaaaatcgataaattaagtaccaagataacctaacgttttgaagcaggagattgataccaattttaagtagccaacgttaacttgagcggaattgattgaatacttttgtatagttgaagttgaatgtaagaagataataaggacaaaaggagaaaaagtaataaagtattttaaattaaagaaatacgaacatgggtgatgggggaggggtgacttaccaaaaaatgagttatgagcattttgaaggaaaccaagttctctttttcttggaacatttacttaatcatagctgcttaactttatgctcctactaaaatagtaataggattgaaagaatgggatctaaaattgaatctattttgtttctttgatgccaaatgcttcatttatttatgtttcctcaatcggagtagttccattgggaacttaccagctataatagtaaaacaactgtatttaggggaagttcaatattagatttaccaaataacatgagatactaataaatttgtgacaaatagtaatctgtgtctttatagtatgggttaagaaattaaaaaaaaaaaaattatgggatacataaaattatactgtttatgactgacttttttacattttcatatgattttcacaataaatatttgttcattttagttctattattaatgctctaaaagtattacttagtaagattctaaatttattaaagaataattagaaacgtgaataaccaatgaaatagttaataactggtggacacatcaatcaggtcctctgatattggtagtactttggtttgttgatcttgattggtagtactttggtaattcgtagtttttaaataatatttgttctcccgtgagcatttatgaattatgagaacaagaagaaataaaggcgggaatagtttcatgcaatattccgtgtaaatttaacaagaaaaaaatttaaaattataaaaaaaatacatactgtatataattaatttaaataattaactaaaaatattaaccactaagcaagtagtgtaaattcaagaagaaaattaaaaacactttttaaagaaaattaaaagaaaaaaattaaagtacaagtaaatgagatttaagataaaaataataatataaaagaaaaatttaaaattaattgaaactaaaattatcgtggagtatgcatgagataaggaaaatgaataaagtcctcgggctaaaattaattctgcattcatctaccaaagttcaaagatgcaaagtatctatgactctttctattactaggtttctgccatgtatcatgcatgcagtttcttgcaatctatttcaaacatcacatgagagaacaatgcctgcgcagctgttataatggcccatctcaaacaaattaagtacctcagcaacatctggttgcggatgctaaaacatcaccggtcggcctctccaatctcgaaagataaattataccaaatcctgtaccttaatttggtctttttcactggggcatcaatgttgcatttaactacatcttggggtggaaacttctaaagattattggtcaaaatcatgcatgcgccactttaaagactgaaacagtatatatctgcttttgcaataattaacgtgctccactgtccaaaatctactctcaatcaaatagccaatgatttcttcatgttagagttggtgacccgaatttttggtgaaaaatattttgagaaattttcgggggtctgtagtggcagcagccatccctgctgtatggacctttattgtgataaggttttacattagcagttacaaaatatatatgctgctgtaacctaaccgcttgtatgcgttctcttgtaccttttttttttcaacatagtaaattgtttctcatttgctcgtgatttttttttctgaaaggattttctacttaaaatctgtatgttaattcttctttcctttatctctgttgcgcatatatttctacacttcacaatcagatccattcaaccatgtagatagccaatcagagaactgctgaacatcatccattcaacctgctccgctgttgaacaaagtgagggttgacaatgtggtgcctgattttttgtgtggatacattaatatttaatgtagacgattatagaaaattgaaattttaatattcgatcacaattgcacgtcaccttctacttctttaaccacaaaataaaaaaaacatacccaacttcgcaactattctacagctatcaatttttttttaaaaagaaaagcaatggtaatgaagcgaagaagccaatgcagttgttagttgataacaagtatgctataatatggcaaagaacccgatttctcatggtaggagtaaacatattgaaacaaaatttcattttctgagggagcaggtgaataaggggatgattgaaatcgtgtattgtccaatagaattgcaaattgttgatgtgctcactaaagcagtgaaagttgagcgatttgagaagctatgaaaggaattaagagttttacctctttgaattaaaggagggtgttagttagttagttcaaataggttagttttgttagttacatagagttggttagctagttattaactaactttgtgatgtacaatctgtataagatagagtgcttatgtgaaataaacaaaatgaatcaataaacatctacaagctttatcattctgtcttccttcttctacacaaatatttgttttctgagtgtaacccaacaaaatcaaacccaagtcccattatttagggcattgacttccaagtcaactccactagtggttctggcaacaaccttaattgggttttagatggagtagaaaaagatgttttttagacataataattgccagttaattgaggatataaaagctctaaatctcatagatcaataaaatcaaagcagtcattttacctttgtcccatctttgcctacaatgacttccaaggcaatgtaagtgatagcatcagcgtgcgtaatgaatggggtagaaatttgatactccatgaaaactaaatgatgaaattaagttcagaactaattaagtagatatatggtgccaggctgctatacaatatgtgatcttagtttcaaaacttattgatatatatctacctcttatatatgtaagttctataaaatcaaattacataaattctattactaaagtaaacattcaatgggcataaattacaaataggaattgttaacttgtttagccaaatgtcttaccatcacaacgaattattactgacggcaatgacttctcattagcagtgcagaagggttagaacctttttccatttgaatagttcttgacaaatttaatgggatgaattgacgtatatacagaaatgtccaaagtggatcacaatccaagttgctatagaatataaaactgatatatgaagacaaataggaatttttaacttctttagccctattgtcctaccatgcatcacatcgaattattaagatgatgggaagcaaatttggagatacgtattcaagcgaaatgggaaacgaagtcatgcttgtatctatatgtggaagagttttaatgacggcaacaacttctaattagcagtgcagaaggggtagaaattttattccatttgaatagtccttgacaaatttaatgagatgatttggcgtatatacagatatgtcaaaagtggttcacaatcaaagctgttatagaaaataaaactggtatatgaagacaaatatgttggaaaatggaaatgatctaccaaaatcaaagctgttaattgaactatgatacttttcagtaccgtgatttatgatatctttggactcagctcaggacttggtgagtagtatggcccaagatacattggtagtctgtagaggtaggtcattttttttttgctcaacttattgcagcactgagtgtctgagtccaacatcaattttgaaaaatctgcttatcactgacatgaaacctactgtaacattttttttgtaaagatgtccaaattctaggtagatttcattcttatcagtaaggtttagttttatcatcctgggatggggtcagggtgaatttttgtttcccaattaacatacttataagtcgcttgtttggataaacttttctataaacacttgagaaagtaaaatgaattgagttttttccataaattaaaatcaatttattcacctcaccttttggaggaacttttataaaattttgcacaagttaaaattaatatatgcaaaaagctcaattattttaagttatttttcttttctttatagaaaattttagcttaagagaacctaaacttaactagttagtatcaaccttgattatggcatagctgccaacatggacggatctgccccctcttaaattttcaagaatagataatttttttataataataaaataaaataaaaaaatagtttaaacgtttgcacaaaatgagaaattgaaaaggaaagtaaaagaataataaaaaagatgaaaaataagaggggagtgagtgtgggtatgtgtgtttgtaatttttatgaatgcagtggccacactcttgttatttttaagcaccggccacacgctaattttgtcaattttttctcttttgaattgtacatttttcacagttttattataatggtttgttcctttaattttctttaaaaaaaatttctgggacgctgtcctcgaactcccaccactggcgccccccttactttttttttttttttctggatccgccctgactgccaagtggaccaatctttttttgcctctcttggtgtctgatttgttacctccgtaacagtggcacaatttatttgttattaagcctgtttgagaccaaaaaaggtttcgtcatactttcctcccttttgaaggccgaagaagaaattataagtgggtgaagtcaccatggttacttaaaaaaaatcatgcttaaacgttagagaccaattcaatccatactctcgaaaattgaaaaggcacatagaagaaggaatttccccgccaatgatcgatccaggaaacatatttttacatgcattggaaatgatgatgtgaatattatggtttatttgttacttattggagttatcttatttaatactcaattccattaaactactgttactagtaaaacttctcgttagttatagagatcatcccactcaaggtttacaaaatgtgctctatctgaatcaagttctagttggcatgtctaagaatcaagagagagaaaaacaaagatattcaatataaaaaatcaaagaatggaaatactggggtctaccggaatgttgttattgtagggttacaaaatgaattttgtttgtttgcgacattgcgtgaggaatgggctcttgaagtcctgatgctaggaccgcaatcaaagtttaatttagctacataaaccacatctaaatttgttaatttggctataaatattcatctttcattctttatcatgtatattttccttcatagtaaatctgtgtgaacactttggagttgcacacaagttagaatggaatcatacatggggatggggtggttgtttgttgtgtgttggcatttgttgctgtttcatttttcattctcccattccttatgccatccccatgacagttttgccttgcttcacttcaaggcctcctttcccattaatacaacttattattataatgcttatgattgccctgttactaacctgaagacaacaacatgggaaaatggaatagattgctgctcttggcttggagtcacctgccaccccatctccggtcacgtgaccggcctcgacctcagctgcagtgggctttatggtgaaatccatccgaacagtaccctttttcatctttctcatctccaatcactcaacctcgctaacaatgacttctatccatctcccttgtcatctctctttggtggatttgtgagcctcacgcacctaaacttgtctaatacttactttaggggtgaaattccttcccaaatctcacacctttccaaattacaatcacttgatctctcttttccacttaattatcagtttctattaaagtggagtgaaagcacttggaagaggctgctccaaaatgcaacagttttaagggagcttgttttgaatcatacagatttgtcatcaacttcaatgaggccactcaatttgtcttcctctttgatcactctaagtcttagaggaactggattaaagggaaagttggcagatgacattctctgtttgccaaatctgcaacacttgtatctatcaggtaattttgaccttcatggccaacttccgaacttgagttgtagcacaacttctctcagtatcttacagatctcatctaatgaattccaagggccaatccctccttctttctctaaccttatacatcttactttcctggatctctcatttaacaaactcaacggttcaatcccacccttactcttagcccttccacgtctaacttttctgtatctctatggtaatcatctcactggtcaaatcccaaatgtctttcaccagtcaaacagatttgaagtattgaatttgaggaataataatatacagggtaagctgccatcaacactttcaaatcttcaacatctcatttacttggatctttcatttaacagattagagggacctctgcccaacaaaataacagggttttcaaacctaactgagttagtgttcactaacaacttactgaatgggaccattccttcttggtgtttctctttgccatcgttgatgtatttatatctagataataatcagttcacagggcatatacctgcaatctcatcatattccttgcggtctctatttttgtgctacaacaagctacagggcaatattccagaatcaattttcagtcttgtaaaccttacttacttatgtttatcatcaaacaacttcagtggtcctgtcaatttttcactcttctccaactttcaaaatctgaaaagtctttatctttcgcagttaagtcaattatccctcaactttgaatcaagtgccaattatagtttctccagcttactgcaactggacttctcttttatgagcttaacagaatttccaaaattatcaggaaaagtcccaattttgaaaatcctgaatctggccaacaacaaattgaatggaacagtgcctagttggttgcacaaaatggattctttatctgctttgatcctatcccataacatgttgacaacaccaatggaccaattctcaaggaattaccaactcacaatcctagatctaagtttcaacttactcactggcagcatctcttactcaatttgcaacgcaagttcaatggaggctctcgacttgcatcacaacaagttaacaggcattattccacaatgcctcgtgaacttaccacatcttcaagttttgaatcttcaaatgaacaaactttatggcactttgccaagtactttttcaaggaacaacaggctaagtacgctgaatctcaatgataaccaattagaaggtattttgccagaatctttgtccaactgcacactactggaggttttaaatcttggcaacaatcaaatagaggatacatttccccgttggcttcaaaaactaccacatttgaaagtattggttttgcgggccaacaagtttcacggtctcattgccagttttaaggccaaccatggatttcccagtttaattgtttttgatatctcatccaacaacttcagcggcccaataccaaaagcctacatacaaaattttgaagccatgaagaatatcattcaagatgaagtggatagcagttcacagcaatacatgcaaacgcaatttagtcttggaacatacgcttcgtctgtgactgtaacaatgaaaggcatgagtatgccacttacaaaaattccaacaaactttgtaagcattgatttatcaggaaacaaatttgaaggagagattccaaatgttattggagagcttcatgcactcaaagggctcaacctttcccataacagacttagtggtcttattccccaatccatgggaaatttgacaaacttggaatcattggatctctcttcaaatatgctcaatggtaggatacctacagaattaaccaatctgaactttctctccttccttaatctttcccataactatcttgtgggagaaatacctcaaggaaaacagttcaatactttttcaaatgattcctatgagggaaacttggggttatgtggagtcccattgtcaaggaaatgcagtaaggaccctgaacaaaattctcctccaccttcacagaccctttggagagaagagaaatttggatttggttggcaaccagtggccataggatatggatgtggaatggtatttggagtgggcatgggatgctttgtgttgttaataggaaagcctcaatggattgtgagaaaggttggaccttaacttaatcagaaggtgaaaaggaacacgttgtataagactcatggaagaataaatcagctcaagctgctgtcatagttaatgcgttttcttttcctctgtttttattgtcgtgaatttgtaaaactatttctaagatatataaatctagcaagtttgtgctcagtgtacatatattaaaatagttgaatgtgtattcacgattgatgttgtaatttaattataaagtatcgtcttaattatttttaataattatttttaaaattaataaatttatatatataataaattgtgattagatgattatataaaaaaattatattgtaaatgtaggtttaaagtcatctctgttatataaatttaaattttacttaacagtaatttttcatttatttactaattgaatgcttaataaagtatgttaattaattgatcccattttgtttatgcgcaatatttattttgtgtgaatgataccaatctcattaattatttcgttaacatgtttatttttattaacagcaaataatatttcataaatgatcatttatactgacgtttttaacgatgccaacaccattttataaggtaaacactctcaaatctcattggtccatctccctcgttcttcctttgaaatgcatttttaggtcacacatgttcatatttaacttgttctgtttttccatgtttgtatcggaagaacttgctattttgtaggaaaaataacacaaatcaaataaaaatcaaatgttataaaatggaatgctattaagaaaacaaagtttaaatctagaatattatctacacattgaatttatgcttctagaaaatttatatttctatataaaaaatatagaattggttttttcaatctctatatactttactgtttattattattttgttttggttataaaatattaatatgaaatatcaatattataaattactatttacttttttttattaaagagtttaggtgagttgaattatgaggcaaaaaaaattagattcaatttggacatctaaaatgaaattcaagcttgatgaaagtttaatttccaggacttttaatgtcttaacctaaattagaacatgattgaattgagttaaaaagatccaatttaatttataatcaaagtttaaagcacaagtccacatttcatcaaattagttctatcatgttgatacctaacctatttttatcacctttattcattgtttgtattaggagttaaatagagagagaaaataacaaggataaaaataaaaagcaaaataggatataaaagatatattgtttggatgaatattacaagtgaatctaactataaaataacacttaaaaatatttttatgttataaattttatttatttattttaaaaaaaaaagtttcatgcctacatatgaaccaattttatctctagggatggaaacaattttctcgtaggatccaaaaaaagttctttacttcccttttattgaatgatgaagaaacatcttctaaaagaaacaaaaatgacaaacaagcatagaaagttaataagttccattttctccttaattcgttgtatcctatttcgccttaaacaagcaataggttaatgaaaagtgaaggagaaacattaaagactaatttattggtaattttgaaaaatattttatagaaaaatgtataataaatgatttatatattttaagaataaaaatagatatattaaaaaattaaaacataataataataataataataatttgattaggtattcataaagaaaaatttattaaaaatcaaaaaataaaattcactaatttatcatccacctaaaatatatttaagaaaaaaattgaaatagttgaatataaaatataaaattgaaaataaaatacaacccacttgttgcgccgaacctgggatctggcaagtaggatctaccaagtcctaccaatgcacgcgccacctcttccagtttccacgattcccttcaaaaccctaattttactccaattctccgtttcacatttgcaatttttgattcccagacacccaaaatataaattatttggtgcatatacgtttttttttctttttttcttttttgatgttccccttcctgtgttgcataacacaacctattcttttaccactctgtgatacccatttgattactaagcaaaatacaactactctctcagtttaattgagttcatttacagttctttgcatcaaattttgattttgaattggtgggtgtttttcttctgttatgagtgatgatggcactcgaatcttgggttctcagtcaccaagtgttcacctccagttccagattgttttgccctgcgcatgagaataggcgaaagagcttaccaatcaaagttttgggtagaaccactagatacccatttccctttgtgcccaattgtgttgctccatctacttttacaatgcttcaggcttcaagttttggagcagatgccaagttactagatagaactcggttgaggtgtttaggtagtagccgcaattgtttgagcgatagaaatgccgtttccaaagccaatttgaactttatacaggaattgttaaagaggggaatcatcctggctgcaactgtttgtggggtattggtgtttggatgttcacgagtttttgccgttgaaggggttgtgaatgcaggatatggtgtttttggacagagcattcttttgcttaggaatacatggcctaaagtgttgcaagttctttgtatatttaaggagcaaggtttggtgttggcagtgcttttgggcctttcagcttttttctcgatggcagagacttcaatcactacactttggccttggaaggtatctatcttgtttatgttatcctcctttttctgaatgataatttatgttacatgaaagtaggagctatgcctaggcaaaaaaaaactctttttacaccgccattattcagtatagacctattaaataattatatggaagttgaccaaaggattgttgccagccttgattggatggggacattgctgacagtgaaatttgttttgatatccaattgctgaaagtttatcaattttgaagaaatgaagtttggatcttgcatgagatcatactgaccagaaattcatctgccatctacctgagtgcaacaccaagatttcttgtgctaattatgcagaatttatgaatgactaaaagttagggatttcataactgatgtatatgttagtaaggaaattaaatgctgtgatttaaggatcaactactagtctattatatttccttttcttttcaaaaatgttttttgttcttttaacatgcttgcagattttgcacatcagatttgttattcactatgattaatttagctgattaaagtttgaacattgaattctaatatctgttgatgacaatgtgtaaggttcgtgagttggccgaaaaggagtctgaaaatggtgtcttcagactactccgaagtgatgttactcggttccttacaacaatacttattggcacaacgtattctcctggcattgatcttattattgaaaaatgtcctattttttttcagtgtagaatgtttctcatgctagtattttgttgtatgcagggtggtcaatattggggcaactgctctggtcactgaagcagcaactgctatgtttggtgaagctggtgtcagtgcagcaacaggagtgatgactgtatgttttgattttcttgctcaaatgttaaaaaaaatctactgtttctaggacatcaaaacatgcttaaagggcttatgcattgatttgattatctaaaattcagatgcactaggccacttgattattattcatttggaacattgaatctttcagtatatcaacatgctgcccattaaacttgcaaactcctgatgtgttgggaacaagaattttacatgtaaagcttgctagctttatcaccaatttgtgaaaaaggtgccttagctaacttttgagtaagatagaagaaaagaggggggggggggggggggggatccgttatttgaatttgtacatttaaaagctgtccatagacagaagtttagacaacattataggatatacctgtcttattttatgttatatttttcgttgttttgttataggatttacaatagaattataaattatcttttcaatcagatagattgcatcaaattgatcacaaaacagtgcatatggtgtgcaagtttgtatgctttcatgtaagttttttctcatatatctgatttctcttttctctttgtaatcaaacaaggttgccattttgcttctcactgaaatcactccaaaaagtatagctgttcataatgccacagaagtggctcggtttgtggtaagttgtaaatttcttgcctgttcttttataatatttgggaacagaaatgatgctgctgattagtcatttttgtttactttttcacacatcatccatatttacatgatatttctgcctcaacttcttttgtaacaaatattgatattgatattgatcctaatgcctctaggtcaggccagtggcatggctttccctggtgttgtatcctgtaggaagaattgttacttatctttcaatggggatgctgaaattgcttggcctaaaaggaataaggtctgttgaaaagattgccagagattaatcttcttttatcatattatatctatttcttttgcttctttatagatgttttgtgaaatctaattttaatctgatactaactaaatcttagttccttcatcttaaggatggtgctcttttattttcacccatgctccatgataactgttcatttcctaaggttgattttttcctaaatgttatgataaagagaacaaatggggaaatgagattattttattaattatgagggatttatatgtggtagatggttgataacagttcttctgttttttggtttctaatttggtcgaatgatgtagcacaaggcagtaactgttttttttccttccctttatgtaatgttgaaccctggtttgaaagagcaactgtggtttgccaacttagtatgtaaatcatgtggaaagtggcatccgtttgttgaagcaatggttgttggacatattctcgttgatttttttgaaattcaacactgaagtcattgcttactttaccagtgagccatatgtaactgaagatgagctaaaattgatgctaagaggtgcagaattaagtggggcaatagaggaggaagaacaggtaatgaatattgggtttaatattctaataatatcactatatatttgtcttcaaaatgtttagccttttctgtcatttatagaaaacaaaaattcctttttataaagatttccaaacatcaatattgtttattgtaataaaaatactaaattagtttaaaaaaacgaactaatgtttttgaaaaaaaatatattattgagtcatatgaattaaaaaaagtttctttttcactaggaatttcgttattggtccgttttaagtttatactttgtaatgtttgaaaaaaccgctagaactactcttttaaggaaaaaatatagaaattaataattcgaaatccatttttgaattgagatttgaattaaacattgattgatgttttcttcgaaaattacgacaattcaatttgagtttttatgttgtaaggaaaaagataataggtaacaagtaataattttgtttattttgataacatttgaaatgaaatattgtattacggtttttataaaaaaaactttttttccaatacaagcaagctaggggaaaggagtcttgagacttgcatttaattctaaattctatgcatcaataggtttgttctaaaaaatgttgtatgtaaatattttcgtctcggattccagtagtgaaaaggaaatcaataaattagcataaataaattttcaatttttcgtatggaaatgagcccccatcatattttctaataatgatgtatgttactctattgtcatgcttctttataacacttgcaaaagccttatcttcattgattgttgtagatattttaatccacttttatgtctgttaaaatttaagcatctcacatatatataatatattacaggatatgattgaaaatgtgttagagataaaagacacacatgtcagagaggttatgacacctcttgttgatgttgttgcaattgatgcaagttcaagcctggtagactttcatcacttgtgggtcacacatcagtactcaaggtatttgaagatttcctgatttcaaatttacagtgattttacttttccaatgtgctaactagatcttgacgtgtttcctagagtacctgtttttgagcaacgtgttgataatataatgggtatcgcatatgcaatggatctgctggattatgttcaaaaggttaggagattttactcatcatgtttattgagttacaagtgctttacttattaattatatatcccccaatctcatagtctgtagaattatgatctgtttgattttgaagggtgagttgctagaaagtactacagttggagatatggctcacaagcctgcttattttgtacctggtaactttttttcatcattcatcttgagattacctatgttcacccgtattcatgcaatgcaatgtagccacagtacatataaaacattatttattttacctgatgattataattgggccagctatgctaggtgaggaacaacaaaaaagcagcaatactctattagatctattgtcagactttttttacatttagcattttgttaatctaaattgctggtgaattaaagcaagtcttttattcacccattgcattgtcatctttgctgtgttgattgtgttgctccatatatttcagtgcattttcagaatagattctggaggctctgaattgtcattctgaccaattcagcatttcttttaaaatttaaaaatgctaatatgctatctttgcttcatcaagatatctttttttcattgataaatttcgcaatatctttaattccctgtcataaacttataatataaacacaccaattggaagggtagcaggggaatgttcaacaatttggctttctgtcatgtgctagtattttatgatgaattattccttaatgtatggacaaagaattaagcagcagctgacttgctatgtcttgactgaacttaatgatcacaatccctgattttctcctcctattgaaattgaattgttaaactggttgatttgtctgggataggaatacatttatatcttttaacttggtgcagaatgttaataaattattattacgatttgcagattcaatgtctgtttggaatcttcttagagagttcagaatcaggaaggttcacatggcggttgttcttaatgagtatggtggaactgtgggggtatgtgcacaccagtccagaatacaaccaactcggatctttttgtctgacataaatgtgaatataaatctgtaaatttatgattcactggtgatatatacactgctaattacaaccattgacccaaaaagaagtatatgaaagatatcaatttgaacatgctattcctattcgtttagtttctttcaaaatcttttccaattatttatcaacctcttttttatgctaatttgaaatcaaagcaaacagaatcaacattgagatcattcccgtcatcatgaactattgcaagaatattcataaataatcctgtagaaatattagtttttatacatgtctaactgtgctacagctgtactcttgtaatatgttgtaccatactgtgtcttgtgctataatataatttaattattttttctcttactttacagatccaaaatcattgtaataaaaccaaaagtctttctggttacaaggcaggctattctgatttctaaatgttcttatttacccactattctcatcttccacttgcctttatctttccttgttcttgttacaattaagtttgaatatctaatggcagtgtttcttggattctgagttcgtttttaaatgattttatggtccacccttccacacacctgttgcatttagcaaagactgggtgtagacataaatcgcttttattgatagctaaatcgagagagaaggtttagttcttcgaacagtttattagattgtaacttgactctccaagtcttctgaaatccattccatataatctgcttataagttctaacaattttcagtttatcaaatatagatgccttattgatatttccatctaacagattgtaactctcgaagatgttgttgaggaaattgttggtgaaatctttgatgaaaatgactcaaaggtaaatgcttgtgcttaatctttactttgtttcttttaaatatatttttaaataactgaaagtgaagcatatattgaattccttcatctttactctgtttcaccaaaaaaaagaaacaaaggatcctttttattctgcactctttgtccaacaacagttttgtatggaatatttatttgtgctgactgcataatctttgtatacctttctcagttatttttattgtcttataactatcaacaatttagatgctgacaaatctactgtttaatggctactagtggtgctttgctaaaagcccagcttgtgttttaggctatctattttcatggcttcagattgctataattcaaagcagttaaaaaatttcacgttttttcaagtaatacaacatgaacgaactttatataaattaacagaatttacagaagtaaagaaagaggtcaaactattgagatggatccgtgtttatttgaggaatgatgggtttatgatgttatttcataactaggaagtcttgtttggtaaaaataaataaaagtaaataaattgttcttggccatattcaatgttcaaatacaaactctccaaagcatcatagtgtaaatttgtgagtacgaaattaaagtaaatgagagggtaaccagtaatgatgtgtaaacgtgataataatgcatataagtgcaagaagggttctgggaagatgtcaagatagaattcaactttgttagcaaaacagagatcagtatacaatttaagctaggtttgattctgaggttgctagtaattctacacataatttctgggtaactgataaactaactcagactgaagatagaaaatgatttgtatgctgaataataacctttttgataaacaaaatgcagcaaaaacatctgttttgggagttgtaagtggtcactctagatttgattgtgttaaataatttcatttagtatagtattcgtgtcaggatgccctcagtaggcagagtgcaagttctgccaggaagaaaaaacaaaattatacattttgttcaattctatcattcctataagtttagtgtacattgcttactcttaatgtttaactgttcaagtcattgtctctaacagcagtaggacattaatgcactttgaatttagctattatcgcctaattatgcatttgattgttgatgactataactatttgtttgctaatttttcattaaagaaagtttttacattctgtcctggtgattcctacaggaggagatacagaaaaaaactggctacatagtaatgcgagctgagggtgtttttgatgtggatgcaaacacttccattgatcagctctctgaagatttgaacatcaagatgccagaggtttagccccttttttacatgcaactgacatatttgtcttctcatgaccctgcttatttgactggagctagtgtgactttcttagttgcactatctagtcagtttatccttaaaaggggaaaaaatccaagatcacaattagtagtatagcaataattaagttgttcatgaatttgccattcagagtcattgtagacccatctttgcatctcaaataggcatccgctccattggatttcaaataggcatcatgccaacacatttcttatgctagcttgttatttctacacaagttgtggactaaattgggaaaatttgcaaactgcattatatttttggagaaatttatgctgataacaattgggtttcatgaatcctggggtttagatttgagttgacagcattgcaaaaaatccaagtcccacatcgactaaagataaaacaagatagagtatataagtgaagggcaaccctcaccccttgagctagttttgggggttgagttaggcctaaactcatattctaagaatctaagatggtatcagagcatatccaagatttcattcaaagggtcacccaccatgttatccatgcaccaaactcaaaagtgctaggcgtgagggggtgtattgaaaaaaattcaagtcccacgtcaactaaagataaagccaagatagagtccctcaccccttaagctctaattgataaacgaagcatcgtaaggatccattaacgcggttttgaaccgatacaaaactcacattctaagaatataagagacaaacaatgatctcattggaattaattttgcttacaattcatattgctaagtctgatgaagaatttcaggcctcctgatacgtaggtgacatctatttcagggtcaccaatatgagacggtatcaggctttgtgtgtgaagcatttggatacattccaagaacaggtgagtgcatcaaagtagttcttgaaagggaagatgaagatgataacaatgagtccaatgctgaccagcaggatcagaaggagaagaaccagattttcaaacttgaggtaatcaatctgttgctatcttaaattgccactcaagatagtcctattgatttttgcatatacagtccaaagttgaagagaatgaatggttagcactttgcacataaattacatcagcaagtataatgatagcataacacaactacagcatacttgcataagttgcatgtaccactttttagttttattactctacggttactcaagctacactaaagatgtcaatgtgattttcctcaaaaagcttgttcaacaagtttgtgctttgatttctggtttttgagcatatggttagtcattagtgaagcaatgtcagaggactcggtatattgtaccctatcaattctacagcttttccattttgtagggttctatgttgtcacgagattggaattatattttgcataatccttgctattttttaacttgtgtgagccacatttatagggtttcaaattaaaatgtttttatttttggcaatctgtatgaagtaataaactgaatctagaacttctccttagcctcccccatcccctttgtctttggaatagaaaacacgcagcttctttgtctttggtgcagatactagctggaaatgccagaaaggtgagcgctgttcggtttgaacgcataaataataatgatgaaatgttggagactaaagtaactcgcatggtccccaaaatcatgaaaagaaaatggagcagtgatgagaactcggacaatgatgcagaatatgacggagatacatttgcaaagagaccacaggatgacattcctagtgaatatttagttgatcaggaaaattctaacagaggttaagtttgttcgttcttcatatttttctcctttctttatacctggcatgcttttgtgccatttttgcaacagcctataagatggataaattatgatacatgtacaaaatgagaagcaatgagttcaagcatgtaaaaccttgcaaaagacgaattagaggagtctttgctaacgaaagtctttaaggctttggtgtaataaagatgtcaggtttttcaggtttgatcaaaacaatgaccattttttccaaccccctctcatacacacacacacactagcttagcactgctgaaacacagaaatttacttgtgtttcttcacaaatttaatggaattaattagaaacaactttcacttcctatcactgggaaagaatctgtcaccagattaaccagttggaaatagatgtttttatctctaccccaaattttaatccttatcaattaatgaacttcaaaattgtactttattcaatactattttactcttctttttttgaagtaatcctatttcactcttaactcccgcttgtaattctttatttataaaatattcaaggaacacatttttgtataaaaatatattataaaatagcattcttttttcattatgatgttatttgtttgaatatttttattttaaaagtaaatttgaaacggaacttaatataaaattcttaagataacgtagtcaaatgtacctttagggggcaaacagatcgagccaggaaacaacaaccaaacatgttttttttccacaaaaatttgtttgacacctttaaaagcaaatttaggcagtatgaaaggttcttagtgtttgaatttgtagatatgtaccatgattgttgtttcaatgttttcctcaaaatgtataaatgtgtacaagcatagtgaattttacttctctaatttttatttacctttaaatatgtgtgcgtttttaaattaaattggaagaagacataatttaattcccttgctattgatgctcgagctataaaaatcgttgttcttggtaagtggagaaaagaaaagagaaaggaaaacagaagaaactacaactgagggaattgaacttaaccctccacggcataagctatcaattcattccacggcataagctatctattattatcatgatttttaccaccattattactaccaattgtgatatttttagatgtgataattgagatttaatttttacatattttttttttattttatgaatcttttagagatatggggttacataaaatttaattaaaaatttaatctcaatgttatattatttttaatcttgacataatgattattattagttattattatgttctcacttaacgaagtgcgttcacttgagtcggactatgtaaacagtttcattaaaatacatgtttaataaattcttatcaaatgaaaactttaaaatttaattttgaaatatactaaaattagttaaaagaaagacttatttaatttgatgaagtttacatataatatgttaaaataaattataaatatattataaagagatcacaaatatatttttttatataaattcaaatgaattatcccatatatttccatcatcatgaacaatttgaacaataaaacaatattaataatgggataatatatagatcgtgatagactaattaaaatttgacagtttagtttaaaaagattgtgcaacggatcgagattctacatcaggaaatgcatgttttctaaaagattcaaattaacataattgttatacaagttaaacaaacagatcataaaaaaatgctacttactctcatggggtacatcaaatttctacaaaatcaaacatacatggatacaattttatttaataattaatttaggaaaatattatcaaataaatcactttctaaccccacatatgaatattagaaataacacatatatcacacactataactagatgacgatacaaattcagattctaagttcacaagaatacgaattgaaagatggaatcataaccaataacatgcacgcatggctagccgatgaagttgtgaactctcttcaatcttcatgcatccttggccacaccttcttcctcaaacatgctgccaccacagctgcatctactacttctcccaaaaagaattaattaagccatgcatgtgttgtacaaataattaatactgataatttaggccatatttaatttaatttgtcactgaaataaaataaaaatgattttcgataaacataccatctgccatcgtgcatatggtcataatcttcttgtttcacttctcacagtggagtggtacggtacctcaattacgatcttttgcagcaccataataataagtagaacatttcataattaacaaccttatgtgtacatgtatatcaagaattagctgaaacttatacagaatcatcaaaacagaacgttaaattctggaattgtagataagtcaacttgaaactttcttgacccagagaaagaaaaaaaaaactgaaattcaatgagttaagcaagttgtttaccctcagtcataagtcatattctcctcaaattagtgaaagagcttaattaagttcagtttcttcttaattagaagtacgatgatccaccatcagacacacatgtgtatatatataaagtatgtgttcaactaattaacttgctacattggcgcgatcttatggattcaacgcggttgccataccgcattatcaaaccaaaaataagtcaacctgattatgttaaaaatcattattgaatcacgtggatggagatgcataattttattttatttttaaaaaaaatgctttctttccgtgaaatatgaatatttaataaattataaaaatcttttaattgccatgaacaaattaagatgtaattttttttctttttcttttgtaattttcagcagtacatttatctgttaccactcacgacccaagaatacattctgataacgttattctcttttttttttaaatgtaatacgacgatgacactgttaccgaagtcatcattttatcaattgattatgtcattacggaatctgacttgtaagttgtaacgtgttgtgatcgtctgagaaccatgcgtgggactcgtgcatgcaacccttcttgataggagtgtttgtagtttggattggattggttttgaagtaaaaaattatccgatccaatctttttagtttggtcatttaatcatttattcagtttgaattttttccatccaatccaatctaatttttttcggtttggattggatcgatctttgattttttaaaaaaatttaaaaataaaacttatgagacttatttttatcaaaataaggagtatctaggataaaaaagcacatttattgaacaaaaataaatatcattttctaatttttattggacaaacatatttattggacaaaataaggaacaatgtattgggtttttgatttttgggctatgatagggaataggcccaagtaggtaaaaggtaaggtaaggtttataattggatcggtttggattggatcggttttcaccaattaaaccgaaaaccaatttaatccagtaaaaaatttcgattttttagattttcagtttttcgatttttcagtttttcggttattttggttatgaatttttcgattcggtcaccgtggtttagatcggttgatgaacacccctactccttgatagtatcttaattacaaattcatcattcaaaagtcaaaactttattcacaagtattttctatttcttttaagatagaataatggacatttggatattacgtacgctaaacatgtgacttatagatgtatttttaaaaggaaactatatactgttaataagtcaattcaatagctgataaaaaaatcaattcaataaagaaagaattcaattttcatatataaagttaatgtaaaaaaatgaatttgtctgattgactaaagtaaaaatgagattaactcatcttgaataactaatagaatttagataattatcttaatataaaattttatcattaatgttaactaccacatttaatacatcatctttaatttttttatatcatttatgtataaataaaaactttatatttgttaattaaaagctaataattattttataattcactttaagtaaatagttattataaaaaaataaaatttaggaaaatagtttcattattttacaacttcaaagtataataccttaaacaattttccatcattttcattataacttttaattaaaaattatagataaagagtataaattttattaaaagttatagataaaaattataaaattaaaattacagccatacatatttttcctaaggtgaataaagaatataaaaattaaaaaacaattattaagattttattattttataattttattacatatatatttatgtattttattataattttaattatcaaattttaattttacacataaattatataaacaaattaaagatggaacattaaatgtgatattcatagcattggttaaattcaaagtaagataattatctaaattatattgattattgaatataagattgtttaactccatttttaattgcggtcaattagaaaaatccatagaaaaattatacaatcaattaatcattaattattttatatattgtttgcaaaaattaataaactttttctaaaaggacaaaacaaatcaataaacttaacatatacagcgattatgtaatttgatcacaatgtaaaaaaaaatatgtaaacttacaaataaatttatatatatacatacatatacatatatatatatatatatatatatacacacgtatgtgtgtgtgacttttattaaaaatagtttatatgtgcattatttaattcgacacaaatatcttataacagaacgcgtatcatatgtaaattgataatttgattatcagtgtgaaagatttgtgcgtggattaattgactaaaatatgcaaagccaactgaggacagatggaacgaatctaattaagtaagaccatactaattaaattattaattaatgtcaataattgagggagcctgatatttttttatactaagattaaatataggtttataataattcatataataagttcaactaattgagttaatttttttggctgagggagtatgatatcttcatagagtgcatgaaaatcatttaatttaaatttatttaaaattatgattaaaaacttatacatttctgtaaaaaaaaaaaaaacttattaataagtactgtaaaataaaaatttgagcgtcaaatgtcaataattccttaatgatgaattaacatttaaatataaatataaatagaaaaaatatgggtgttgttgacttctgaaactaatattttatctggtcacaccacaggggcgcaaccttatgtggcaacggttctcttcttcgatccctttcttgcacgtgttgttaatcttacatgttatgctccctcttcagcctttacacttcgtttttaggtcagaaatctattaaaacagggagtcacaacttcacaggaattatatgtctaacttttcattctaacaaggagatatatactatgcattagaattcatttttcaatatttcttttgtttatataataaaaactcagtataactaacctctaaaattctcaggatgagtctgcagactacaagtgacaaatcaacttattttactcatgcttaatttattggtatgccttttgtttcacacaatattaggtgaacaaaacaaatatgtagacccaaatagatagatgttcatgtactaaaaatatccatagacactcatgtattgtcaatctatacggatatacctaaagaaagaaaagtatagatatgatatgagatgttacgtgacaagaaaaaaagataaagagaaataaagagtttcaatcaaatatttacagtgagtgagtgtttacatatctatattctacatatgcaacatgttactatcctagcatgcatactaaataggcaatacaaaaagcttaaattttattgaatttactttagattaaaaaccctctcgtgacttaattttttattttttagttttaagcattattttttttatatatttttaacacatgatttaaattttggatattttaatgattttaaaatatgtcttaggtcacgtaatcttcgtcctgcgttaaaattaacgtagctcgcgtaagtgttgaatgcctggctagcagggcgtgacctacaacccactttgagattgggtttgaactttgaacagaaagactaacctgttttttatgcagcccaaaatggtcctaaaatattatcatctatagtccacaccatcgtaaaaaaaatgaaatactaaagagaaaaaacttagagaaatcaaataatataaaatgaatgtaccaaaaagtcattgtccgattgattctagattcaatcctctaaagtaaggtatcagtttaagtctgtttatgaaaagaaaaaaaaattgtaattgagaagagaaatttcactaaaagtgatcagtcaggtttttgacgtaaattaatcaccgataaatttaacaaatacttcacaccagtaacatattatccaagaaatataaaatgaatgtgatagagattttttttaatcctctcccgtggttttaatcagttttgggcttaattttgcaagataagctgtaatccaagaaaagagaaacccaaacacacaattaggtgttgtggttttctagtctagctacaattaatttgcatcctaattaactgctccatttgcggatcttgggatttattccagaaaaatgggtgcaattcagctgtaaccttagtgacatatatacacatcatgacaagaagattcattcaagagagtcactctccctttattggcatgcattttaatttctttcattcataattccctcttttaagttgacatacttggtcacttattcggtgctatcatggtagtgaaaaatctgacaacgacaacgctggaaaaagtaccatgtgatcaaaagccaaagtacaatacacgaaattctttgaataaaattccttacgaacctacaaacttgattggatcagtatgaacatttatgcattatttgaatcctaaaaatgttcactacacgcacattatacatcactggcagcacgtgtttttggaccacttttccaaaatatttgagtcaagtagacaaggttggccataggtatacgtagcttgtgtatgaagagtgggtgtgtttgaaacattggggcggggaaaggttgtgacgtaacggaaccattaatatgtatgtaccgttaatgtctctcatcttgtttgcaaccacatttatgtagtattgctgttaaagaagtagtagaatttttcttttttctttttttggtcttcgaagaaatcactaaagactcgttcaaataaaagtagacaaagtagacaataaggatatagtgatggcaactttacagagataataacgactactgctacgacctttatctttctaatgaaaatagtaaaaaaatacttaaagcaattaagatggcaagatattcatataattttgacaaatttatattatgagatattataattgcacaactctaattatacaaattgtgttttgaagatacaactcacccgaaaattaaaatatttccttaagccactctttattttctctctctactccactctttattttctctctctactctatatatttcgtcacatttagactatataacatcattatcattagatctctcccttattaagcttttacatacccacattaaacatatagcttactagagtgtcttagtatttgcaagtcaccactcatttctctctaaacaattattcaactcctccatcactaaattgttgaagcactctccaatccaccgcaattataaatccctctgacccattatattcccactgattatgttggattatcatcgataagttcaatttcttccattaaatctagaaaaaagttatgccatcccataaagaaagctaaatggataacaacattataaagaatattatcaaagctaacgcactatatatcaagctaaacaaaataaacttgttataattgaaaagaatattcaggcgactttgtagaacaaactcacgattatatttgacaagtaaaacacttgatctctatataaaaattaagcgtctctttggagcggtaatgatttttaatacatttttttatatatttttttcactttttttaaactaagaaaaacttttagtgaatttgatttttaatttaaaaacaaaacacacatttttcacatttgtaaatgacactttttgttgtcaataccactatcactattgtcatggattgctattgccaccgctaccattattaccattgttgtcactactataattgactatcaccaccacgatcactaacaatattatcatcattatcattgtcaccatcgtcgctaccaacattattaccaccaccactaccaatgtcatcattacaactactatcattgtcaccaccaccaccactaccatatccgtcatcgtaccgccaccaccctcaccaccaatgttgtcgcaaccactaccatcatcaccacttgttgccaatttaaatttcacaattcaacaccaccactatcctaccaacatcattgccgccaccacatatgtcatcgccactaccaccaacatcaatgtcattgccactcttatcgtcattgtcactacctccatcattgtatggtcaccaccccatcatcaacgttgctgcaaccaccaccaccaccacatcgtcaccactcactgccaccaccaacaccgctatcatcaccgacaccattgacatttctactactactttcgttgtcactaccactaataccattttcgttatcgttgttgtcaccaccaatactactatcaccaccatgttgtcattgccaatcttccaccacgaccaatgtcacctttaccaccaccaccaccatcgtcaccaccattggtactgccatcatgacctggtatcgttatcgtcaccaacatcattattgtcgtcaccaccatacaaaaacattcttaaattaattttaatatgataagaaatattttaaatgaaattatttgaaactagttatattttaagaactgatttaattttttaaaaaactaaaactaaaaattgattgtaattttttaaaaaaattgaaactcaaaactaaaaatcatcttaatagtacctaaataacctaattatacttttggtcaaatattttagggatacgggattttgatttctttagttttaattattcactttcagatttttttattattgaaattaagtgtctttacctcaaaatcatatctattaatttacataaatgtatcaattcaaaggtatgacgtataattgatttatataaaacaaaaaatattaaatttttaaacaacaaataaattgtacacaaactatttatttattttcacttaattattttatatatttttcttgtacaaatcagctatagatcacactcatatcacatttgtatgaaatattaaatgaaaatttagaataataaacctattcaaacaattagaaaactataaaaattaaatacgaaaaattaaaattagaaaactaaaatcatacatacataaactaaaaatggaagaactaaaatcacaattaagcctaacaaaaaccacttcgatcgagcattggccacaaatcaaggtttgagtttgaccacccgaaaggataagattatggaattgttgcctttcatttgatacccctccctgaggtagggtctaactaagtatataacgaatataaaaatgaagtgccaaatctgcatggacaagatcataaaataaaactcttggggatgttgtgggctctcccagaaattcgaggggcctccgtttagcatgacaaagaacacaactcaatgagtgtgctgtgtgcatacatggtgtggacctttcagcaattggctgtgtgatattgatttatttatgaactttttttatatttaaagaagatgtggcattgtcctatctatggttgtgtgtgttccctcccaaacaaattgaaatgtaaaatgtttgttccattctttcaccacaagtccacaaccaaccctttaatccttagcctctttccaaggcctgtattttccctcccttggtccccgctttacaagatttgagtttctgaatctcaaggatcttatgcaatggcacccattcaacttgggtccatatctttatctattttttaattccttaatgatttttttttttcaatttaatgatcattaaattaaaaatcaaagaaaactaaactctaactatagagaaaaaaaaaaaaaaaaacccaccttgtgtgactcaaaacttaggagacaggcatgacaaaaattgccgaacttgttgtgcagttgaagagttgaagtactaaattcagcatgttggattttccaaattattattatttttttttttggaaaaaaaaaagatggtgattctagtaggcttttttaccatatgaatgttttttttctcttaattactaaatggaataaatcgtgtcatgtgatatgatttttttttttccttttttttttattttcactaagaagtcatgccatgacatctgaatgcatattttaaaaaaaaaaaaatagaagtcatattacttagtatgatttatcttatttgataatttttttaaaactcactctaataagacaaaaaaaaagtccccactatgaaaaagccgaattctagtaattggggtagttccaagctcgaatattaagcaaaatattttgcctaagtatctgactattcaacatccgtgattttctagaaagttttaaattttaaaggaaaaaataaaaactgcagtcactactttaatataaagtgtgtagaggtcactatatttgattttgcaaaaaaaaaaaaaaaaagagagagagaaccataaatggtgtctttgctactacttggattctgagtcttttcaaaaagcatcactctgtttatttttggattaggatgtcacagctctctgaatgtaagtgaaggttattgtactgggagaaaaagtttgatgtggaatgagcaaaagttgaaaaaagtttcattcttgaaacatttgcagcattgtgtatatcctgttattcgatgggtatattgcttttgaagattttgtttttatttgtttgcttttttttattctctggacttggaaaaagtttgacctggaatgaggaaaagttgaaaaagtttctttcttagaaacatttgcagcactgtttatctccttctctttgatggatatgcaccttttgaagatttgattacctgataataagatgactgctatagagaataactataataaaaaataagataagatgtatattatattaactattatagataattattcaaaataatcttatactagacatatcttatataataacaactattcgttaagaaatctatcttatcaaatcctatatattttatctaattaacaactattcaaactgaaagtctaatattttctataattttgtttttaattatttgttcttttttaattctttctgggtagaaaaagtttggtgcggaaagaaagttgaaaaagtttcattcttgaaacatttgcaacactgtttatctcctgatctttgatgggtatgcagcttttgaagattttgtttttatttatttgttcttttttttattctttggggttagaaaaagtttggtgtgcattgagcaaaaattaaaaaagttccattcttgaaacatttacagcactatttatttcttgctctttgatgagtatgcagcttttgaagattttgtttttatttatttgttctttttttattctttggggtttacacagtcgtttgagattataccaacttttctttgttttgcaaaaaaaaaaaattggacctttagtcaccaatgttgaaatgtcagtgcccggtttttaatttgcaaatgctgattcgttttcttgtaaccatttgttctgttgcgactttctaatggtgtgtgtgattaatgcatgtggatatttctgagcgtgtttcgtactcgtttccatattaggagcaagacccatttctgggctgcattaaagttacttcctttttgggtgatgacagagaaaattgaggaaaatataatgcactgtggagtgttttcctattctaagacttaatcactgttcctgtattgctaggtttttttataatatttgattcttggaatagggcgcctttttgcacgagaacatcacctttttttttttttttttttgtttctgttggatttgtggaattacttcctcagaatttgtacacttttttttttggttttggttgtttagtcaattgttatggtatattaggttttcaattttgttttgtaagattgggactctggtttttttgtaccctatatatgtcttgtgctgaatctttgtgatgtggttttgttgtgtttctttgtgcttgttttgtgagcagtattcactaaattttgtttacgcgggctggactttttgcagtaacaagagaagagttatgtattctccatacacaagtatagtcttttataaaattcagaaatttgagccagagaatgctagaaagataattgattatatcttctttcaaggccatggagaacaagaaatggctaaactggcttcataccctgactatttcatccgtgaagtggcagttcaggccagaaaggaactccaaagattggatgctaaaccagatatgctcgcaatgtcacgtactgtaaaccctcagcaaggtttaagtgatttatcagtaatctcccctagaactcctacttcaccaaactttcaagtgcctcctccctattgggatccacaatctgctggcaacgtcaatccaaactttatgggaacgaattacttggattctattgtagaacttcagaagcagacacagatgctcactctggagaatcaaatagatgctgtaaaaactggaactggagggattgccaatgattactatggcttagatgcttctgctgccaatttgggtggaaaagctgggagaaggttttctgaaccaatgaagatatgtcactatttcaacaaaggattctgtaagcatggaacttgctgcagattctatcatgggcaagttgtccctgagaaattctctcagatgtatggaaatgatgatattagtgaggatcaggtgatttccccggggtcactggcacagttagagtctgaaattattgagctcctaagaacaaaaggcggtccaatgtcaattgcttccctgccaatggcatactacgataaatataaaaaggtactgcaagcagatggttatttaaccgagagccagcggcatggtaagtctggctatagtttgacaaagcttcttgcacgactgaacaataatattaggctaataggcaggtaaaggcttatgatttttttttttttttttgcatttattatttatttagtgtttgatgtttcttactctaatttggcttttgttgtggttaatttacagacctcacggacagcattcagtggttctggcagaagatgctcccacacaaatgcaaaagggagattttgctcgaaatatcagtgcttcacggcaaatatatctgacgttcccacctgacagcactttcacagaggatgatgtctcaaactacttcaagtatattacatcttttgttattaaagtgcatgttcccatttctttgcagttgttaattatttgcattaatgaactgacttttatatatttcctttgtagcacatttggacctgttgcaggtgtcagaattccaaaccagcagagaaggatgtttggatttgtgacatttgttcattcagaaactgtcaaaactgtttttgataaggggaatccccattgtgttggggattctcgggtgcttgtgaaagcttaccaggagaaggcaaaggttaatgaaaggtgaattccctgtcttttcctttcaatttttttttatattggaagttcttgtagttttatggtttgaaattctcatttattcctgtaaatgtagttattttaagttaatattgtaaaataaaagcttatattttttagtttgaaatgactacataattgtcatcaatattgctagagatagcataatttgatgaaaatttattccttgctgttgattacttgattcccttgttcttagttcttcctctttgttctcccctttccatttattgaaaaaaagagggcaagagacaaaggatgaaatccatgtgtctaatttacacaatcttttatttataatgagtcataaatacaatcaataatggttaccctaatttacataaatacacacagttccctaattacaatatttgcataatttctaacatatttacatagtctctcatacatgtttataaatcataggcaccaagtttatcacatgtaactaattgtgtttggtcctcatgaaatattggatcttaggcaatatggagctgcctgattgtcacatacatgtgtcatttgtgcaacttccccaaacctgaattctttgagcatctattttaatcacattagttcacaagtggctagggccatggcttaacattttgcttatgcattggatcttgcaacaacactcttatttttccaagaaatcatggtatcaccaataagaatgtgccagaagtgataccctgtcagtagggagagcctgctcaatctgcaatggaatatcccacaactctagtcgttcttttgtcgtcttacaggagaacttttctagcttcttcaatatattgtaggatgcaaattgctgcatccagtgtccttcacagggaggattaagtatttgacttaccacattgactataaaagagatatctggatgagtaatagtgagttagttcagtcttctaaccaatggctcaccctaaatggtagaagcttggcattaggatccataggagtgtctacaggtttagcatccatcaacttgtctcctctaagatatccattgcattctttctttgggaaatgacaataccattcttggattgtgtcacctctattcccaagaaatattgaaccttgccaagatattgtccaaaatgtagaaagagatgttgctttacatgtacaatacaataatgttgttgtcaacatacacaaccaagtaaatcaatcctgtgactgaatagcaagtgcattgtttgaagtgtgaaaactagtctgctctgtctctctctattctttaaatgcaaagtaagatggacaaatgtagtatattgaattggtatttacatctaaagaaatcttacgtgcttctgcttatataccttttggtataattctcttgggcattgttaatgtcttcttttccccataatactttcagtgttcatttcaatttggatgcaggaagtacacagatagaattgagcaccctgtttgttattcaccacgctctgtagatgtcgacactgaacttaactcaagtatgacattatctagtttataacccaaattatttcttatttcttatggttaacaattaacttcccaatgattggttttctcatccaagttatttaatgatctgctttctttctgttcccttttgtgggagaagcctttgtacaatctaatgcataattataatttatttagttccaagaagttttgggaaccatagatccattaggagacagccacaactaattgaagaggaagaacaggagcaagtcctggaacttcagaggagaagtcttgcacagctgccgtttgcccaaaaatctttctccagttcacctcattttggcttctccatggatgagtcaaggatttcagatggtgtgtgataatatatgttacatttctatttatcaagtttctgtatgttctaactatcattctgagttatattgattgaaataatttctcatgcagatcacttcaatttccagccagcagaagaatctttcagttttccactgcatgccaaatccaggcatacagactccaattactctggtgaggacaggtatgcatcaatttccaatagacttctctccctctcacattctacttcctacctgttttgtatacattaggcttaattgtactttttgtttctctactatggtcgctgggattttgttcccctaataatttttttattgaatttagtccttcagttttttgttattataatcaagtcctttcctatataagttttcttttttatctaaaactctcaaattctcaacttttgtttgaaaatctctatgaaccagatccattaaaccattttaaatcatcttttgttcaaaaccaagcaattgatacattattttaaatcatcttttgatcccaaatttttgtctttgaaacctcaacattgtacactataaaatgttacacattttatcaaattttgtattgtgaacctttgaagtcattttctatctcattcattttaaatttctagttatttgagttgtaaataactatttgagggttttatttaaatagaaatgatagaaggatttgattgtaaccattctgatatatctctataccatagccaaaccggtaaatcccataaacaatagttcctttcatgatttgtaaaacactaacagtatatttggatggagtattttaaaatttcaggaaatttaaaattcaggaaaattaaaatgcatcaattaaaattcttttattttcaaaattctgtgtttggataaagaaattaaatttcttcattttcaaaattttgtgtttggataaagaaattgaatttcttcgtttttaaaattttgaacctcatgcatgaaaaagaaattgtacttgtgttgggacggagcaaaaagttgtgcagttagagcttctagaaaagaagagaatttcaatttctcacctttttagaaggaaattcaaattccacatttttagttgtttaaaattctgttttaaaattcaaaaaatttaaattcctcacataaaaatatccaaacagtgaattttaaattgaagaattttaaattccctaataaattactttccccaattaaaattttctatccaaacacactctaaaagagatttgtaaaacactaaaagttttctttcatgatcttggctggagtagaacaccattcgttttgtcaagtagcaaatacgagacatagtaaaagttacctctgcttgtttacaatttctgtgtggatgatatcatttgtttgcaaacatgcagttttgctgctatacttttcctgaaatattttgttgactatggataatgttatttatttactttttaatttttatccagcagtcaaggactcaatctcccggacagtccattcgcattttcactagatagtgggaggtaaacagtcatagtttcagatacatatacaagaaatatagagtccaaacagaatcaggccaatggtcgcagctttcttttgatacacaatatagttcttctatggaaatatttctcaattagtgcagtaattttagtcaaaattccagctagtgcatacatgctgaagaagagacactggaagaattttctcttcacaattggaattggtggcattaacaaaagttaaatgatacatgtaagaaggttatagcttttagttacatagcttttagttacagataggtggcaaaacgtttgaattttagatcatatagttatgagttttattcatgaagtcattagtaaaagtactaggtatattattgtccaaagttttaattagattgaaggagctcttagaatccgtgtctatgttttgaggaactaatttacttactatgaaccgctttaataatggtttattgcaagtccattaaaaaaaaaaaaaattaaaactacgtaccagagatttcatgcatgtgcaggtaagggggagagatattatacagtcttattcttgcatatgcaaagagattgtttttggatttgaattcatgaccaacaagtcatgggttactaaactagaaatacatagtaagttatgctaaagtagaatcttgaattattgttcagggttgtcatgttttcaggttgaatttttctcactttaaaccactacaaattccatccccaaaaaccatattttgattgtgcatcaactatatcaactgtatttaaactgttagataatccttggtgatgacattactgttaccatctctattactgttatcatctctatttaaactgttagataatcctaatcggtgatgacattactgttaccatctctattatagaaccgtacattgagattttcacttcatacggttgtttcccctacataactttctatctcaaagaaaaagtatattatcgtttataatgctaatgctagataagaagcttgattgttttagcttgcttttgcatcatcaattactgttcaattttcttcatgtaattttcgctgggaaaatatgcttaacgaatgtgaggtattacatgatttaggctagcaggaccaagataactcgagtaaaatatatgagaagtatgaagctcatacagagaccattattcattgtgcatatacgatacgaacaatattagtcacaattcacaaacgaaactttataacaccagcaagataaagtttggaagatggtaaaaaaataaaccaaaatcacttttcgtcattgatgaggaaacaatcattaaataaagcttgccagagcatcatcgtccattccattgtaagcaacatgacaaaagttatacgagccagaaaacaatttttaatttgttaatatttggatggcaatttatttgaacgtgtacctatattgaaaacaatgtttaatgtaatgaaccttaattttaacctgtctcttgcatcatctgctattcctgtgaaatcttaatttcaaaaaattaatccatttccaagcatgtgctaataatttctcgtcatttcttccctgtaatcatccaaaaagtatcttccatatccagttaatgatgcggatacctttgtttttatcataataaaaatatcaatctctaacatgaatctacccatgtttgattataagaaattactttattcattcttctgagaatacacgactgataaattacaccaactcaacataaaccaagcaaccccctccccaaaaataaataaatccagaagatagaattcaattactagtactgaagataaaatgaatgttatttcaactcatacatgtgatacaaatggccgcggggtgacaaaaaaattatgtattggtctggtgcaggtgacaaaggtaacagaagccctactgatctcagatacacaaaagaatgaaaacagtaaaaagatatatctacacaaacacatcgttggaggtaaaaaggaaacatgagagtagcgatgacagaatccataagctggatcttagagttaaaattgatacaccttcaatttataccaataaaagtttgcaatatggtccacaacctgcgatatgttagagacttatggttaataacagcatacttaatgtattaattattaactaacaaaccagctcaccttagggtgacaaatttcaccatgatgtgttctgcttttcagccacaagcacagcaataaaaaacttcacaaaagtagttgggcagcttctgctgagaatcagacactgatacttgagtgtgtcatgaaatcatgtgatgacagtatgccaaatagccagctaaactctaattattgagcttcagccacaatgcagaccatcacgaaaattttatagcaacatgttgcatgacaataatattacaacagattcttcttccagtattcatgcaagttgacagatacaaacttgattctgatctgtcacatttttctttcatatttctcagcaaactttttaagtaataatctctgacgaaatgccaaatatttatccaaactagttccagcccactgttggcaaaagcattcatcagttggaactagagatccaagtggaaatggtccttttggagctttctttagggaaaccaagaacctatgacgaggacgaattctctggtctaaagataagctaagatacatcgggtatttggtcaaggattgcacctcattgttaagttcattaaccaagtacaaatatttgggctttagattctcctccaaggacagagatagcacctgcaggcacattagtcaacattaacaagagatacaaactgttcttcacattataagtatgaatccaaaatatacaaaaatatacaacaatgtcatataacaatatattattttcctagttctatttgtgcaaatgtagggcatcctacaaaaacagtataaattggaaaggaggaatcgaaattaggaacggtaaaacagaataattttcataaactaatgagggaaatgcatgcaaaatgacctgtgttaggctagtcaaaactttcacaatgtctgaatttttcattcctatgctccttaggaaatttattcttggaagtaatccatcatctatgctgtaatggagaagttggggatgttttgtcaccatcttcacaatgctatctctgggtgcacccaactctttggtaagaaatatacaacgagtattccatgaaatgtcaattctctgcacaagaatctggggactaagctgaatgaccttacccaaatctttttccttgataccaacttcctcaattaaatacctaaccgtaggttttaacgaattctcaacactataagaaaacaaggatggagcagcagcaacaatttgccctattctagaattaggtatgcccaggcccctcaagaaagcaacacgagacttcaaattgttctccactgtatactcaagaatttgtggctgcctcaaaaggattcttcttacatctctttgtttaacaccaatactcaataagtattctaacctttcctgtgcggaacacacattaatttgaagtgattgcatgcgtctctcatacatttggacaaagtgtgattccttcattccaaaagtgcttaagtaatcaagaagtggtaaccatttcacatccaaaggaatctcctcggacaaccgcggatattttttatcctttacatttctactatgctgcaacttgaaaaaagaaagataaataaacataaggttcaagagcaccacaagtacattaaatggcacaatttgacagttcacagcttactgtatcacgatttggtacctttccactctcatttctttgtaaggatgctactctctcacttctaggcaatctaatgctttgttcattgtcaaaagatctcaaaccccactcctgttcctgttgcctatcttttcctgcacaaacaagagtctgaatattcaacttccccccttaaaactaataatcaatataacattttcaagcatacctttagttgtctttgacttaaatctcttgttgttattaccatctaagttagcaggctcagaaaattcctcctgcacacatgttccacaatgaaagggaaaattaacaaataaagaaacaatcatcatcaatatcaaatttcaacagataattaaacattcctcagttttttacattggactaaagaaacaattcaaatgcataattaaaaaacccacttcacccatcaattgaattagatattcatcctagaatttaaagaaaacttttgaccacacacaatgaaatcacaaagctcacatcagaaagccaatcatcatcgtcgtcctcgttgtcgtcgacgtccaactcttcatcgtcttcgtcgctatcgtacagcgacagtgcctctccatactttgacttcctgttgctcttgataatcctcggattggaatgtgctgcaagtttcaccaaattcttcaacctcgcagaacccaaacgctctctctcaaaaatccaaaattgagaacaaaaactcgaaggagtcgaaaagtatagcaatggattataaggatagtgaggcataacagccgccattgttgcagagagaaacagaaaaagaatatactccaaaaccctaataatcagaatctctgcactcccagaggtttatcttctttctatctgaaacggtgtcgtttttacttaaaaccatatctgaaacatgagtcacacaatgtaacgcgtaggtggcgcgagcccgtgggctaaaaaagcccacgtggcattgtttataacggtttggttgttgtgaagtgtgaaatgaacgagcttggtcagttagttaccgtaccatggaagcagtatcttcttctttgtctctgctttcgttagggagtgtgaaaactaggagcaaagtctcacagaactgtcatgtgactcaacaaagacaacgttgtaataatgtttgtgttaagaatgcaagaagaacaagggtggctgctgtgcctgtgaatgttgatgatgtaaccacagtacttgaccctgccccagtggaagtcacatggcaaattgtggttggagctataggtaccttaagtcacacagcacaacctttgatattttactttacttgtgatgtttgtttttataggacaaacaaaactttggatgcagtttattaggtgtttttgatattgttattcttaaatcaaattagagattttttttttatcaataatctgcttaataaagatttgcattaaacatgttatcgagatgaaacttcaattctgatttgagagcagcaccaaaagactgcagttatattttgtgcttatctttatggaaagagaacggtgttccgaaattgggttttgattttgtgtgtttgaattttgcagctggggttaccccttttgtggtggcagggattgaatttagcaaaagaattgtaagtcagtcttttggttgagctgctaactcataagttatgaagcccgtgtgtttcatgccttcattgttggataatgttacagttagctcaaaaaagatgtgaggtgtgtggagggtcagggcttgttcttagggaaaaggaaaaggactatctccgttgcccagaatgtggtatgatagcattcacttcttcttctcatatcatgtactctatttaaccaattaagtatgcagctgggagaatgttattgtatgtctctgaaatattcctgatttatggggctttctgatgtctcagtaattgaacatcaaattcagtatcttgaatgtgtgtagttataaattatttggatttacattgaacacctaggaattgcagaaatccctgcattcccaagctaatttgaatatctattgtcaacctgagaatattttgatgttgaaaaggagatatttttcatagatcctctttcttttggttcacagtttctttcattttggttatgagcagctatgacaagtgtatgatggtgaattctagcgtttctttagtaattccactccagcagtgtaattaaagtaccattggttggtctcactcatgaaacttctgtttcaaacccttaattattctgaaagtttaaagagaaaggaataactggatttcacaaccataatatcaatttagaaactttgtaaattatgatcattagtctgacctgtaccaataacgttacttctcattgctttgttgtttccctatttttcttgtcatttatgttttgttgatcaacttttaactaagttattcgtgtcaaattgattaccttacagtccttcatgtgctgtatatcgcaggtgggtttcttccttggcaatcctggaaaagattcttctccggttaatttctacagcattgtactaaaaagcatacttcaacaatgacaactttattttagcagagattctctgtttgtgataacattctctattatacacaaatgtaaacaacatagtaaagccatttgcaatgattaccaaataaattttttttaaaaaacattgtaattccttttttgagagaaatggtatttgctaccttattgatatactcaccctaggaaaaaatttgggtgcatcaatgatgaaaaataagaatgaggacttccttctgtgataagatcaagctgctgcacatatatccgatggctgatttcataacaatgtagcttgttaccaatattagactattattttttatgctattggaggcattttaaaggtgaagtcttgatatttggactgttttttttgaagtggtagaagcttggttttctagctgttttttcattgtaggttgttcctgtgtctaggattctgattgaattgactccaattttcagtaatattcacatggataggatgtaatcagactggcttacacagtaaatgcattaaattgatagagcaaggatttaaagccaatactagtgaatttagcttgggaagcatgagcaagccattattgcattttctgtcgcatacattgtggacttaatatattttaaaagaacttttaatgcaactacgcgattaataaaatttaaaatgtgagaagttactaaatgtgttactacttgttactatcttacaagtttgagaacagatgtttatttgaccttatccctttttccaaataatgtatattcttaacaccaatcatgcccaaattctccaagttttaccgtctatttcaagctacggatagttgttgaacgaatccagaattgaaaaacagatgcctcttgtaaagtctctcgaggccattttatcattttgaggttgattcgtttattccacttacaatatacctcgtattaaatcctttatatcaatatcaataccaacgccatatataagaagattcttttcaaattaggcagccatgattcttcttcatcttcatcttcttctctataactatgtcattactgatgtcacatactcgtaattgttacatgacgcttggctacctaaagtagtctacacgaatctgtaacaagatcttccaaccttatccttcgtatactgtccctacttttaggtgtattgtcttacataattgataattatcttaggactttatcatattgactttgaagagtacatgatcttgcagtaaggtaagactttactgacacacaaaaaagtgccacgttgataaatttatattatgatgattattttttctccattctgaaataatatatttctttgtgtctctaattataagatattattttatttatgagatatagttaacaaatttttatttttattataagatttaattttatttctcttgtgtatttcttattttttttactaaaatatcctggattgtctctttctctttcctatagagatttgagaaagattaatcgatttccaataaagttaaagataaatttgaaaaaatattataattatagacaaacttaatattaataactaaattaattaaactttttaataaacataaattagacaattatttctcatagtcaaagagatagagggagtagtattttgtttttgtttttgcagttttgcatttaagaatccttggcttggtgcttgaattagtacacagccacaattttggacttctaattttctatctattaaattgcatttaatagtattgatggacttcaactacaaaattatgctactttattgcgtccctttcccgctttctaaagggtgatgtgatgaaacggatcctttgctttgcaaccaactctctctagctcaacctccatcaaatcacagtagaatattacatctaatgctgcacattaattggtcccaattggtccatgttaatggaaattggtcaattgtttttggtatattggtcaatactgacaaattttaatgtcgattgactaattcacaaaacattggtcaatcttccattaacatgcaccaatcttacgattaattgattagtcgtaaaacaagttaaccaatcgctagcctcttaaatgcaatgtatggttgtactagatagtagtaatttgaatcgggaaagtttattagagaagattcaaatttgtaatgtgacattttaacaagtttgttgagtatttaaaacattttattactagtaattgcttctaattatttttaaaaaatattagatgatttgtatttttaatataacaaagatttttataaaacattttctatttttactttcagaatcatagttctaaacgcattcatggggcttcttcttcctttttttttttaagtaaaagaagaagaaaaatagtaaccaccaaaaatttatgacgtatggctgacaagaaattcatgtcatcctatattacgatttatgacgtgaacaatcagggtgtgcagcatgttggtgttgaattgaaacaaacagaaaagaacaaagtgaaaccagtttagttcaaattccaactcaacttccagaattggatagcatctaaagaaattggttttgcaacactcgaaaggaacaatacaaacacagcagaacgtactttaagaagataaagatacatttatgcatgtgggtgtgattgctcgtgaaagggttgaagccaaacgcgtcaagtttgtgtttaattaaaaactgctcttattgttgcaattataatgacgcatatctgcatctataaaaaatggggagaagaaagattattgatggtattatactaattaattttatcattgagggcctacatcaattcacatgtgattgtttcaatttaattaattcagatttgagtttaaggaaattttttgttattcataattattgtaactcgaattgtttacggtgaaagataaatatagtcaataaaaaaaatactaattaatgcctaatttccatccctaaaaatgaaaaaaaaaaaaaaaaaaaaaaaccgtgtgggggcaatgttatcaaccaccataccattaccgacacgcttcattgttttttctttttcaattacacgcgccaaaacaagagacgtcaacaaacgaccaaactaaataaaaatcttcatgtcgatgggaaaaaatcacttttcttcctaaaattaagattaaaatgtaagaaaccgctatgtaaatttctggaaaatggtttaaaatactcattttaactcatcaaagtatgcatgtattgactccttacatgatttttcttctccttcacacgtcagtctattttacagatacgatttgttaagtttaaaagttaagttattgacagttaaatcacgtttttttatcagatgacgtataactgaaatcgttgcttgcatctaatgtttacgtgtcatgcacgtgcgtctgtattcggaacagtggaatccaaataaaacatagaggtttcagacttgttattaggaattaatgaatgcttatcagtttatgaataatctgtcaaaaagattagttaattatttttaatgaagtttcttttcttaatctgtatttctttattcataagacttgattctcaaactcaagactttgtttaaaatttttgaatctaattcagttctaaccaattacatattttaaaaaatataaatatttaacattattaatattatttttttcattttagtaaaacatttaaattttattttgtaaccaacgattttaagatgcgttaaaaatattctttattttttatgttaaaagagcaagtaaaaaattatgttttgaaaaaaatgaagaaataaaatggaatgcttaactgcttaagaggtgattaacagaaataacacgaagttaactttataagattattgacaacgagtaaaggacaaatttgggagataaacatgattgaatccgcttagtggtaattttgtggggggcgagaacaagacttattcattgcttaagtaagcgttcctataaaatatagtactcaacaaccttgtatttgttctttgttgaataataaaaccacaaaaacaaaagcccacatgcatgccaattcctcgttgcatcagttctctattgttttggcttcaaagttcagatcatgctttccttttcatttaaggtgagagtctctgaaaatattgtgctgatcttgttttctacttttcttgttttgtatgaggatgttgtgggagggaagtggttttacttttttaccatatagattatagaagtgttggtgctgctcatgttgaagttgaaggagatgctgcatcttgttttatttatcagagaagaaaaaaagttacttttatggaagttattgagcttgtaaaaatgggttgctgattaacttttaacaatggtatgtttaaccgggagcaattacttccaaggttgatccctttctggtttatagtaatgatttttcactttttttgtcttgcttttcagtttaggtttgttgaatcaacagggtgattgatcagaatttctgtgtctcagtgtgtttgaactttgaatgaatttgtatttgaatgcttattttttatttttagtttataattggaagtccctattcacctttctatgtaattgagttgaagtttagagcatgtttaaagaagtttgagttcaagaaaatattaatggatcttatgagtattcctttaaggaattgaaaatcatgaatagcatgtgggaggcatttctgaacgatcctattttttttttacttttttaatgaacaaataaagggaccaaaaaagcaaaaaaaataaaaagaaaaaaaagaggggtctccctttaagtagcagcaagtgctccaaaattcattatctagttatatttatcaagtcaatctccatttcttgattgcatcaaatttgaaagcacaaacaaaaacaataacatgtggaaagtgaaaagctaaagaagagactgattataaaaagattcaaataaaatgataaaattgctgttttgttcggatgttaagaactatattctgttcatgtggattatgaaaatcagactctctttggcgtgctgctagttggaatagcatataataaatctggaaaatataatatgttgtatagtttgtttttctagttttaaaatgcctgcttatgccttcaataaataatccaactctgttcatattggtttctagcctttatttgagtaatatattccatatttcttaactcctgacatcaaagaataccaattttagacaatagcctcaatactacctgcttcttattccatcaggactgagactgcctttttgttttatatggttatagcttctattattttgctatctatgtttgttgcttaaactgtagtgttaccctttctgcagaatatcttagattttgagaacactgctcatgtccagctggaattggagtaaaatgtggacaacgatcacagaccataaatagaagttcctgttgtttgttgttcaaaaaaatagagaaatcagaaaattcaggagtgtttataccagaaaaacattttggtgttgttttcatatattcaaagtaccagttacttatcaaatgcaaatgtctcagaaacataaaatgtcctatgactctagcaggttcggcattgagcctgcgcaaaatctggggtcatgttgcttcctgcaaagtgggaacctagactactactcatcctctgataacggtagccatgcaacctacccttctgtttgtactttcgaacaatattgcaccctggaatcttctacaaacaacaatttcccttccctaaattctccatctactgtcagtttctcacctaacaatagcccagtctcaaagctgcagtcaaaatcaaatgtgttgagttcccagaattcgcttgaaattgttaatgattcgctagaaaacaaatcttgcttgacacttaacgatgatgagctgaggcacaagataagagagcttgaaagtgctatgttgggacatgatacagatattctggatacttatgataccataattccagaagaatctgattcgtttttgaaagaggcagaaaggtggaagagaatgatggaaatgatatctagaggggatttaaaagagatgctttgtacatgtgcaaaagcagtggcaggaaatgatatggagacaactgaatggttgatgtcagagttgcgtaaaatggtctccgtctcaggcaatccaatccaacgattgggagcatacatgttggaggctcttgttgcaaggctggcctcttcaggaagcacaatctacaaagtcttgaaatgtaaagagcctactggtagtgaactcctttcacacatgcatctactttatgaaatctgtccatatctcaaatttggttacatgtcagcaaatggagctattgctgaagccatgaaggaggaaagtgaagtccacattattgattttcagattaaccagggaattcagtgggtaagcctaatccaagctgttgctggcagacctggagcaccccccaagattagaataacaggttttgatgactccacttcagcttatgccagggaaggaggccttgaaattgttggagcaaggttatcaacgcttgctaaatcatataatgtaccctttgagttccatgctatacgagctgctcccactgaggttgaactcaaagaccttgcacttcaacctggtgaagccattgctgtgaactttgccatgatgttgcaccatgttccagatgaatgtgtggatagtcggaaccatcgtgaccggttggtgagattggcaaagtgcttgtctcctaagattgtgacactagttgagcaagaatcacataccaacaacctcccattcttcccccgttttgttgagacaatgaactactacttggctatttttgaatcaattgatgttgctctgccgagggagcacaaagaaaggattaatgtcgagcagcattgtttagctcgagaagttgtcaacttaatagcatgtgaaggggcagaaagagtggaacgtcacgagcttctgaagaagtggagatcacgtttcactatggccggattcacaccatatccgttgaactcctttattacttgttcaataaaaaatcttcagcaaagctaccaaggacattacactctagaagagagagatggggctctatgtcttggttggatgaatcaagttcttattaccacttgtgcttggaggtgatgatccaatgacaactggttcatttttgttatttcagacttttagttagtttatgtatcatcctattcttctttcgcggaattcatagtcaagttactctatagtttgttaaaataacacacttgatttatgttaataatgccagaaccagcaagctcgatctcatcaaagtagacaaaagaaaaaatggcaagcagcactatgtattctatattttgctatgacacgccttacaaagataaaagaataatgacaatttacacctacaaaacatgttagctgaaaattattacaaaacaaggaagaatagaactgggattttttactacaaatttttctaaggtaaactgcatttcttctaacccagttgagtgagacccttcatattcaccatcaacttcatttactgcagttccagcaattatcctgcaaattattgcagcttttttcacattatgtactctggcagtggcagttgttctgtttctcaactctttgtcacttgtattcaagtgaatctcggcatatcgtgtgttgaaattaaactgaattatttgacaaagataacaagatggatctttacacagatcatgaagtttcttatcagatttttcttgcaaacatctcattgtagtaccatagaaccgcaacagttcgttcccatcaactgtgctccttggattccttggattttgctcagaggccaccttcttgacatattctctatacttctcaaacctttctaggacttcttctgagtaactcaccctgaggactgttctaaccttcttcagtggctttgatttgttaaaccaagctttttgaaagatcatctccacaatttttcttgatgggtctccaacactaagctctgccataattttataatgacattaacaagttagtagaacaaaacatatagatagtgaaagaaaggataaaggaagtaagaaagtataaaccaattgctctagctagtttcttcttataagcccgttacattacaaggacttctgaaaaatcataattcttatatttcaaacttctttatcatgacacaccgagttacactgagttttgaagacaaaagcatgatgtgttcatgcaaataggagcagcatgcaacttagtaacttaccatgaagccttcccagtgtgttgcttggtcttgaaaccactaggctagttggagtttccattagaggtctattatatccattcattttctccttttctgcaacatagccacttcctttgccgcattttgtttgctgcttgattacatcgttgagcttgtttccacatttgacattatccttcaaggagacccatatggcatgcatctcttttttcgctcctcttcctccctgtgtggattgaaatatatgagcacaaaaggaatggcttcttgtgaacaagtttgaccttgttgtctcagtaacatgcacaaaattgagggacaaaaaacaaagagtaaatttttgttcactaaactcattttcaattttatacatatagggaaaaaattagtttatttattaaaggtataattgtttttatttcttgctgtctgttgaccaaattgaaatttatgtatatggataaaagattatattttgtttttatgcataattgttttcaatttagtttttatattttacaatgaccgtgtgttaattttactgcattgtaacggcaacaaagaaaataacattaaaagaaattaaaacctcttttggtacaagttttgaattaaaatgcatgtagcattaggacaaaaatatatttcaaccttttctttttccttctgtccgtataggacacagatgatggatctgttttaaaaatgagtgagaaacgtctgctctggaatgcttgagaaaggcaagactacggtggactctccttagtcatttattgttcttttgtcagttttaggcaagcagttctttgatttttagttacaatgtccatatcatatgcctagctaatcaaattttccaaaagcaagattaacttcaccagttcaatcatgaaatatgttcctaacatataattttttgggcttaatcttacgcttgagttatatcattcatacaacactttttacaatatcaattttctctttatttctcttcaccgcagtatttatcttgcatttttcttctattcctacctctatctgttgtataaaaaaattacaaactatttgtacaaatatatataatttctcttttcatttatgaaaaagaaaaagtgatatgctcaagtctaaagacaaaatagaataacatctgtttgcatattggttctgaaaagtcgcttcacatattaaagacacaatcatacagaaacatggttgtggcttttttctttggtataaagagtcatgtcactagcattgctttttccatttatatgataaataataaagcaaacaagagatcaaactttcttttatctctaatttggtgtttatttctttaaaaacaagaaccattcccgttagcataaaaaaatcataatgggttcaagctagatgatgatgatatagtaaggatacagaattgtgctcatggtaaggatcagcccataatccatacatcttgattccataaataggacacaacgtggctgcatgattcttcagtcatggttaagctaagacaaatatatgaatttaagaaagttgtactttacttgcactgcaattaaagaccaacgtgaacatgtcagaattgttcaaagataaagccaagagaatccaatcgtcataaaggatttactcaatcaatattccaagtatggcagtatgtaaatcccaatgccgattgactaatacaagaaattcatcctatatctaagcaaatgtcgtgccaaaatgcaagatgtatatttattgcaaaaatagtgttaaattcattttgctcttccaccaagctagcacgttcagttataacataattattcaattggctccatcacctttcatttgtgtttctctttctagcaaaattcttgaatgcactccaaagtccaaatactactactacgctaaactaatcacaccttgagaagtggcaatgaaatatgacagtggctaaattaatgttattgcaatgtactaggaacatgcaaagaaaaaaaaccccatttttttcttctattcagttttctagaaacaacaagtgcagcacatttgccaatgctgcggtccccctccctaaattacagggtgaaagggaccgtgtccttttgtatgctgaaaccaaaggattgaattgttaatgtctgtgaggacaaggtatatgtacgtataagattataacatccaccgagtttttcgtatgtgaatagagcatagacacatttatctatattcacatccctctcaatcatattattaaaataaaaaataaaaaaatcgtgttaggccatcttgatatgcaatggtaacatcaaatcttctcattaagcaccgcatcttattaagacaatcattgatcacaggtcttaacaaacatcggatacttatttaagcatgtgcttgtttctgtgtggggtcaagatggtaaaataagtatttacaataaaagaagataaatgttaatcagtactatgaggatattgattaaggaacttaaagtaaaaatatttttattgagagataaaaaattatgttattcatgatttttttttactctcttctataatttatacaataaatatttcttccttttaattctttaatcaataccctaagaatactaattaacaagacccacacaaaaggaatgttaatgttgatgaaatgtaaggagcacgaggttacatcatatgtgagacctatttagttaaataaatgatgatagtgaaatttcatttaaaatgtgtaaaaagtagaaaatgaggcgtttaggatgaaaatggccttagagagtccaatctacacaaaacagtgagaatatccaacatgtacaaattcatgatatcatttattcatttagtgcacggtgcacttcaattttcaccatgacaaaacaggtcatcaatcacgggttatgtacgacttgtaaccagtgcagtggggactaaggttttgtggaggtaactttgatatcagcttcatatttatacagaagaatttggatataattataatttataattatacaattacaaacggcaattagatttaaaagtcaagatggagctgctaccaactctactaaacagaagcgctatggaatagtgatataaacataaaagaactatctgcattttcttacagaaaatgagatgttacacatttgaagctatacccgccaaaaataagaaaaaagaaagcaaattgttactcatagttttttatttaatatctgttgtgtaatcaacttcatggacccattagtattcttcccatgctctgtgggtatggatatgaggaacggtttaaagatggaccatcactcctattgtctctagaaacatagggatttgagctgttatttagaacaccaaagtatactggagccgaggtagtatgaacaaacttgaagttggaactgctagtatgagtttgtgtgtccccaaactctgaatgcagcattttcccttgcccatttgacctatgttcagcagctgagctaattcccattccaaggtcaaggctaatggtatcactttcttctaacttagttcttgtctgtccacctgctgcagctgctggtactgccatgtcatggctgctattctttgcagctggtacatcatgattgtgtttaccctcatatgtggttatcactgcttttggatcatgagatgccctctccacatgttttctgacagggcaaccagcatttgtgcatttgtaatagctcctgaataagaagcatagtaagatacaagattaacaaaaaatatgtagttgagtagcatattttagcactgcagcgagttagtatcataagcatggatcattaacatgaaacaagcctcattcatcaaggtcgaagcacacatttgattttaattccaagctttcaagcatttcctgaagtagcgacacactaatataactggaatcatgagaagtaaccttttgagtctgtaattatggcatccacagtaatgattgtcaccacgaaatagaaagcgttagtacatacatttcctaggtgaatatcgccctatttataaataattgttcacaagtgcccaatgacataataaaatgacatcaataagcaggcttagttgtaacattgggatcggctacactagtcattcatgaaaaccagcaggatggtaatcctactttcctaccatcttcataactgagtataaaaattgcaatgatgcctgaatatcttcttgcccttcctcttcaccccaccctaagttttcttataacttcgtattggcttgcaaaattaatattcactcctttcctttggaagcaacatatattccacaatactttcctatatctaataatctactgccactttaatttgccactgtttctttgcaaacttttagaaatcatgcttttaatttccaacttgtatcttaattactaggtatttagtcactctagttcctttttaagatcctccatccccaccagttctcatcaaccttcacccatatgtccatctcagtatcccttaccaaaacaaatctataaagttattccttgtatttcttaattaaacccacaaaagttggtgcttaccaaaaattccctccattttttgcaaatatatatatccttcatgtctgtatatctgaatatactctaatgtaagatacacactgttttttatggaccatgttggctacaaagctgcaacaggggcctcaaagcctcagactatactaaaacccatgataataaaagaaacagattgcaaagcaaaatggttgataagtgaatatatataggcttcaataaattattatatcaagttgattcctcactttaactgttgtctagacatcaagtacaacagaaaaaacttgacattttacaatattaataaaaaagttcatttgacaaagcacattcattaaattggaatttataaattaatttctattcttagtttcatcaacgtgaggacataccttgggttaggattgcctctcacaaccttttggccatacttacgccagcggtacccatcatccaatatgtcaacctcactcaaagtttgtacaacaacccgtggttccctaataggcttaactacaggagtgatgtcaacatttccaagttccatttttctgctcaaaaaaaaaaaaaaaaaaaaaagaaactcagcagcagcaagtgagcacacatgctggagaaaatccagagcttcaaccaaattgtcataccttcgctttgagaagggatcgtcattatcaacctcttcaatagttctgtttgacgcaaacccggcaccctctaaaccatcataatttgttgctacaggtgatgactctggagtactgttgggctcagcagcatgagacacctgaccatacatagtggatgctttgtctacaattcaagaattagaagaaaagaaagccagttattttgtttgcaataagtaataataaaatggaagctaagatagatggctggtattaccatctcggccagccatagaagccttatcagatctctctccttgaatagacataacagtaccagtagagtatcggcagcttggttgaggtttaggatgatcatgtgttcccttgtaaactatctctgtgatttgaccatcatgagagcgctcaaaaagttttttcacttcacagttgggatgtgtacatttgtaataactgcgaggaaattcacttcctttaacaagcttttgcccatattttcgccaattgtatccatcatcagatgttttctcagctgcaactgaaagtccactgcctctaacctcaacatgtgatgcttgaagcccagtagctgtgttgcctttgtggttaatgtcatccaaatcaacatcaacaggatcactagcactagaactaaccttttgtacaggtgatgataggcttaattcattagaaggaactgctatctcactttcaactatgggtgaggaagcaaatgattgagtttttcctggaccttctacttgagtagattgtttacttacatggttgttgaagtctgcaggaaccttaaaacgagtgaatagcattggataagtgctaggcaattagtaatattcaaaacaatattaattagaacatgaaacatgacaacgcaatttgtttccatttaacactttaaccccccaaaaaatatctatttaaaggattataaattataaaactacttaaatgaaacatgactttcggaattgattttgtctaatgcgacaaagtgatgagtaccaacaatcttgacaactttcaaatctgattaattattccatcttgtttagttagtatccagatttaaaccaagtaaagtcacgggagaaagggaaacaaaatccaagccccttcatccatgtgatttgaaagtaatattaatcaaagtgttgccaacatcgattttaattaccatattcgatctattcagtggtttgaattcaaagaaacttgattttctggcatcaacggtattggtattgaagcaggcagaggttactggaaatgtagcagaggaagcagaagccatagaaccatgtactgttggttggagcttacggaaggaccctgtagttggtgaaacctccacctgcaatgcatggacacaaataatatttaaactataatattctttgagcaactgttgttgagtcaaatgaaaaattataaattcaaatgcacaaaaagatactggaaaaaataaattctcaaaaaaacaataaaaagaggggggagggggggaagccaaaacaagcaagttcctgaatacctgcaaaccctaaggcctcaaacagcaatcaatcaacctatgatatcagtaataacagcggaaaaagagtatatatatatatatataatcttatgaataagccaactaattgaacagttttatcagccagtgatgtaagcaacccattataactgagcgtaagcaaagttctccattttctcctgctgatgatattgcatgttgtttatttggagtcagtttgacaaagatagcattgtacattataatatgcaaaagttagttatataaacaatcaatcataacaaagaaaagacactctcacatgaatgtagcacagaattctactcaaattaggaccatccagacgattaacgtctagaaacaagtcccacaaaatctagacccacaatctttctggcattccttatactattctcacagcacaaataacttaaatcaatccactaatcgttgcaatgcattgattcgtttgttccacatatataaatagtaaaggaaaagaagacgacttttcattgcactctgctgcaccgttgaaacaaaaacaaacaaaaagggcaagcaccaacaaaaaagaagattcattatgtgaaaaaacaacactgacactaaaataaataaaatgagaatgtcgagcgatcctaagctaaagttatattccactaaacagaacaccgtatttatttgagcataaagcagccaatacataatcctataagagcaaaagcatcagaacctaacggacccatacacaaatgaactagtaagtgaaggatcaaaatcaaacaagtgaagagccaactctaaagaaacaatgtgccacgagactaaaccagcatataagaatttagaatttcacaaaacaaaaaacagcatcttcagctcattgctcatcagcattcaaatcaagtcattttaagttatcaaattattccaccaaaaaaaaaaaaagatttgacaccaacccagataagccctattgagtagctgagaaaccccaagaaaatcgtagtgaaaagaacaaaactttgatacgccactcacaataagtgacctttaccttacatgggtcaagtaaaaataaaaaacagcaaacaaaacctttgaccaaaatgaactcaaaaacaacaacattcccccaatgaattcactcaagcatttacctttccttcttctaatccatttcctctcagaaaacacaaacccctttgaaaaatgaaaattctccctcataacacaagccattttatttccatttttcaccgaaaccaaaaagatttcaaatgagcacactcacactcaccttcatgttggaaagaagaaccggggattccagaaacgacgtcggactgagccccggaggaatcgtgatgcacggtgacctcgagatcggaagcttcgccggcgacaacagcttgtacctcgccatcgaattctgacccgacccgtttcgattcggatcctcggatgccccagtattttggagcaccgaactggagcggggttcgccggagttggtggcggcgtccattgtgggcggtggcgttgcggagagtcaaaggagaagtagggagggaaggaagggcaaaagggtcatttcaatgatgcattttggtgtgtgttgtgtcagagatgtttgggagagcagagcaggactctcagttgacttgcaacgttggagggatctctttctcacacaactcattcattcatctgtgactctctcttctctgtcattttaaaccctttctaacatttttttttttgttacttcttagtaactaaactcacaccataaaaaaaagtcatcatgatagtaataattgatgttgaatttaaggagttttcatggttggatcggattcattcagattttgaaaatatttttggttctatgtaaaggtaatctttttgacaaatttatttttaaaaaatgaaaatttaaattttgacaaatttatttttaaaaaatgaaaatttaaattttagttcttaagagtgaaaaaatatgataaatacattgattggttaacttttatctattatagttaataaaagagcgtatatgatacgaacaaaaacgtcacaaaaatgattgtttaatatgactattaaatagattggaccaaaatgtcaataaatttttcttagactaatttgttagatcccaaatttcgtttcatttaaggaaaaatataatttaatcttcaattccctcattttttatcgttgcaagcataacattataataaatacttaaaaaaatagaaaaacaaacataataataagcataatattgattaatagtcatgatctatatattactcgaaaatttctaatgtgtcaccttatccaaaatgaaatgattggtacactaacaatttttttgtattgttacaatattttgggtaaggtactgtcacattaaaaatttcatcacaacagacaaattatacttattaatcaatattatgtttattattatgtttgttctaacttatatttgcttccctatttttttaagtgtttattataatgtttattctcgcaatgataaaaaaaaggaggaaaatgaatattaaattatattatacctttaaatgaaatgaaatttgggatcataaattagttcaatgaaaaattattgacattttggtccaatgaaaatttactgaaattttggtccaatctattcaacattcatgttagtaatctttttacgtgacattttatgtctatctatacctatatcacgtaagctctttcattaacggtaacaaatgaaagttaacatatagataaatttgttatacttttttaactttcatggactaaaatttgaatttcatctttcaaggacgaatttgtcagcgctgtatacattcaggaattaaaataactatttagccttaaattaatcctattaaaagtgagtttgtttaaattttaaaaaataactttaaaataaatatttttttatataagtgtttctttaaagaagtagataagatttattttttaaaataagcaaaaaaatatttttaaaaaactaaaacagtgtagacaaacacattaaaaaaacaaaaaagttgtttcttttattaaataaatattcattccaacaaaataagtttaaacaaattggtcctaagattataggagtatattggtttgattcatgtcatgataaaaaaaattattatatttttaactttttgtttttatttattgtttattttatataatttttcaatttttttatcattatataaattttcaatattatattaatatgataatataagatagaaattttctttcttttaataactagtttttttatcaaaaatatcaagaagatttttttttaacaaactttgttattagttgaattttattagaaatcataatattataggagtcttattttttatttaatgaactttactattatgattttcaataaaaatttataaataagataatactattatataattggaaatgaattagagagtgtatttgtaacattccttcttcttttttacttcatttagtatttagtttcttatagttattatattaaatatttcattaatttatttatccaaatatgataaaaaaatcataaaataaatataatcaaattataaggccctcagtaacactagataaaataataagaaagtcaaaataaataaaaaaggaaagaaaaacaaaagtagaataaaaatgaaatactaaaatctaaaatcaattagtttcaaaagttaaagaaagaaagttgataagacgtaggattagtttggattaaaaaaaaatggaaacaaaaccaatcataattgattttgcttatatttaaaatgaaaggaactaattgatcaacaaattcaaactaattatattagtttggtttggatttttagatttttcaagtcaagatgatttcataatacccatattgaattgtttgtagcttaatacacatgcatggatcattattattcaaaaattattattaatataagagtaaataagatatacatcaataatataaaaaaaatcatattatcattcgattataatcttgtaagtgtaaaaagttattattttacaataatcaacttaaaaatcatattaacaataatttcttattaattgataatataaaaaaatttacattaatggtacatacaaattaaactcttaaaataattattataaaaattaatacatgtaagtaatttgttgataatataaaaaaaaatacagtatatattatttattctttgtttggaaaaaattaaggcgtgaacggatgggatggagagagaaaataatcggttgtgtagatttaacttttagactttttaaagctgataggtggatgattttgtcaatgaatgattcactattggacaaagattttgtaacaaaatgattattttactattcgttaaaagaattattattttttgtgtttgatgtgtgttttggctaggtaagagttgaaagtgaaaagtggtgtgccaagtaccaactctatgttactcttcaccatacacaatcaatatgagtgattggtgcaaaactgcggttccctttccacaagttgaaagccaaagccaaaccagaattggttcagcaaagggttagattcaaataatttaatctcatgaataggagagtcaggctcaagcaatgacctcagtgtgtagttttgtctatgttatttgaactttgatcacatgattcaattcaaggaatgctctgtcggcaattcccatggggaaaattagcaagtggatgtagcgaagagaactggattaaaccataattagttcacagaatcatgttgtgtttgaggtttttggacaatactacctggtttagggcatctaaatgtggcaattgttgacctgaccaattaattccatttgggtttgctgattttaaaaaaaaatccatttgggtatttttcagtcacaacaataaatgagaatgttgtcaaattttcatggatatgctgtaaagatctaagaaagaataagttaacatgttggcctcacactattaaatatcttctttactaatctcataccattttactaaaaggggttaaaaagaagttaaggctcaatttttggtttactactataatgtatagagtattattaatgaaatatggtctagaaaagcacaagagatagaaacatttcattatagtttgttttcttttctccattcggtgtgtgtttttactttttacctgtgtggagacagataagaaaaggaagggtgtacttagcctataattaggtgaagagataggaaaacaacgacaaatctaagcatttaacggcttgagatgcagttaaagcaaaggtctcactggttttctaattccttacaatttttttatagagtaatatatttcctccctaatgaattttactatattaaatgttaaagcatgccacattcaattcaattgcatatcagagcatgctatccaaaaataaaatcacctaccttatctatctctctcaacattttttcttatttgctgacaaaatttcccagataaaactaaagtatgaatcccttatttataacgtagacagtagaaacagttaagagttgttaatttcattggcattcctctcaccatcttaccgaccatctatttatccaataattttttgccactttacaaactttggaaatggctgagtgcatttgctttctcgaatttatttaatgaatgaaatttgaaaactgtcgcaaaaataaaattatgtatagaaagagagattttatcacattaagagttcgttaagtatcttcagaatttcatgtgaaaatcttagaggtgaattttggataaaatagtttaaaggataaagaaaactcattcttaagatttttaacaatgggataccaaactaatttttaaatttcagaatgtggagaagaaactctacttttttttaaaaggaaaggtactcaatcataaaaagcctgtttgttaatacttttattaatatgatcccttaagtatgctcagtgctcacagaggtttggatcttaataatgtgtacggaattttttttattagatgagatagagcctatttcaattatctctatattttaaaagggactaattttcaactattagttaaaaatactcttaataacagtatctcttactgtattcagtccatcattcttaattttttataaagaagtctatcattattgttaatgaaatgatatgattctgcttttggtcaatatatatatataaaggagcattgaataaaattttattaaaccccaataatattaaattttttcttatttttaataaattgcatattttattgttgattcccttaaaatttaatgtatgaaaagttcctattgatatcattcaaaaccgaaggtgaataataaaatattgatgaatcatatattaaaaattaccaaaaactgaatagatacccatcttacgattgataaattgcttctagttgttttgtcttgtattgacaaataaattacctctatttgttttgaattttcttatcttttcggcaatgagaataataaaaacaagaacgtgtataacgaggtaggaaaaacttcctcacaaaaatagaggattacttaaattaaaaatccagagaaaattcatttcatgaaataataacgttgaacagctaaaacaacttatacagaaaactatgtatttataattttctagtattcaacgcttccaatttactaaaacatgttgtctaaatttttttactaaaacataagaatgaattaagtttatttaatatttctgcatatattctataattaagttttctttgacaaatatttaaatcaatcaaattccacttttcaatctgtgctcactaatatgaaaatcttgactccgcatagtgtatttcccactaatgttaaatcttgtaaaactactcatgtcccgttgataaaaaccataacacagacttcaataatatattcactaatattctttgccaaattcaaacttctatgcttaaagctagtcgtccagggtgagttacaccttgttagggatgcaaagtccatttcctctgaatgaaattctcactattcactaaccaaaaaagaagaaagctggccagtcatctacggcccattttcatggaacacactgagaatacgtctcaaccatcagtgtagtaaacatttccaaacatatagaaaacgaggtctcttacatgttacattaccaattagcaatgatctcaaaaggtgagaggaacaatctatacaacaccaaataataatacagacacatcttttcttaggtaatagatcacttcataggtagaacagtgtaaaaatcctctcatacacttacccttctttagtgttaactattctacggtaaaactcaagctaatgcacattgacagagctaatgacgtccaggaaacttaaagatcaaaatactgtacgtacagaaacatgtatcacaaaatcagctggtgctaaaattgttaagagaacctccctagtagtgtgtgtataatcgaagtgtcaaaactcattttctcaagctaatcttattccaccaacattatgttggttcgaatgtaattgagtttctttaagtaaaatcttgaattttgaacttgagaatgaaaatgaacataattggaaaggaatatcttttattaaagatggtcgtcaatttttttataaaaattaattattaacaaagttgatagatactttacacttacaacatagtaaataaaaaaatgttaatcttaatattgttttttatcattagctaatcttaatctcaccagcctcaatgtgattatttctttatattctttttttttttggaaaaaaaaaatagagcgggaaaatggttgctgaaatccagattcaggataggcccacgcagggcactcacaaataacccaccataaggagacctgggattcaaacttaagccacgtgtttgtcatggacttagtgcgatcaagggagccaactcccgtaggcaaatttcttaattttctatgattgacagtactgaactttttacccacttcatgatttaaatgatgcaaaatctatagactaaaaaatctcagacagcccaaaagtttattttcctacaagggtttaacttcctacacccaacaaatttctaatacacccagcacttatttgtgaaataccataaatatccttcttgattactttaataaaacaaaagcattcaaaggtgatttgatttttctaatacacccagcacttatctgtgttttcgcggctcttctccttctccttcaaacctgcgattttgattctccggcgcattcaatggtgtgcggttcttgtctgtggctgtggacggagctggtggtggtcggcaaagctgttctggtttccggcgcgacgaggtaagtgacctttggctcggagtcgtttgagttttggatgcgtacagatctcgaatccgtaagctgtacagtatacggattacagatccgtattaaggaatgtgagccccgttgccttacggatcaccaatccgtagagtccttacggattgccaatccgtgggatcattacggattgccaatccgtgggagcctcacggattgccaatccgtaggagcctcacggattggcgatccgtaaggaccccacggattggcgatccgtaaggctcccacggattggcgatccgtaaggaccctacggattgccaatccgtgggagccttatggattgccaatccgtaggggtatttgcttaaatttttttaaaaaatgaatgaacttaactgctttaatgaattgctatgtgtttggtatggttgaatgattcgtaaagtatgttgtgtaatggtatggacttgttagattattttttatcctcgacatgtgtatggtttgatcgatggctagataatgtgtaatattatgagtaaaatgaactctttaaatgaattgttatgtgaaaagcttgttgtctaatggtatggacatgctacattggttttgatctcgacatgcatactatggtttgatccacatttgttacgttatttgaaatgtgatgagcaaattgaactgttttaataaattgaactgtgaaaaacatgttgtgtaatggtatggacatgctacattggttttgatcctcgacatgcatactatggtttgatccacatttgttaggttatttgaaatgtgatgaggaaattgaactattttaataaattgaactgtgaaaaccatgttgtgtaatggtatggacttgctacattggttttgatcgtcgacatgcttactatggtttgatccacatttgttaggttatttgaaatgtgatgaggaaattgaactgttttaataaattgaactgtgaaaaccatgttgtgtaatggtatggacttgctacattggttttgatcgtcgacatgcttactatggtttgatccacatgtgaagtacatgttgtctaatcgtatggagctggtagttggtttttaatctacttgttaggtttcgttatctgaaaggattatgcttatccaaatgggtatgtttgtaatgtaactacttggtttcaatgtcagattatggctaagacgataggattacggtgggctttggcaagagatgccagtgaagaagaacccgctgtacggcgaagaccgacagcatcagcacggagacaacgccagaggactggtgttgttgaggacgtgcctgctgaggtagacgctgacgatgttgaccatggtgcacctgttgaggctgaggtcgagggaagcatcgatgcctctgatgttgacggatttcccggtgggccccaggacacttcagtgttgagtcattacgatgaacatattgcacctaggatttggaggggggaggtatgattgtatttaaacatagttgaatttgataattattttcgcgttagggtatgtgtatgtaactaacaactaatacaggaactgccggagcttaagttggcatctcatgggaggaaggtgcataaatttggccggcctgcgcctgagattgaagggttggtggcaggtacaagattaagcccactgatcacctgttcggtagatacaggtgaccggggtttaatctcggcatttgtggagaggtggcataaggagactagcagtttccatttgccgatcggagagatgacgatcacgctggacgacgtcgcgtgtctatttcatctaccggtgatgggtgggctgcagacgtacgatgtgttggacgttgatgaggcgattgcgttactagtagatttgcttgaggttacccatgaccaggctgcagcagagacgaaacagtgccatggaccttatgttcgtctgtcatggttgcgggagttatatgatgagaggtgtcagcagatgcagtggacggtggcagccagagcttatttgctccacttggttggttgcacgatttttgctaacaagagtgccacacatattggtgtggtattcttggagccatttcgtgatctccaccagtctggcgggttcaattggggggcggctgcactccaacacatgtacgataacttgaactacgcctgtcagcatcatggtaaacatcttgctggttatattagtctgcttcaggtaaattttttttatataagttaaaatttgttatttgtttaatgtgaaagtgaatttcaactgcttatttgtgtttggttgtttttgttacttaagtgttgggtatacgagtactttccaagtgttggcagcatgattgcggataaggactatgtagagagccagccacgggcatgtcgctggaagccggggaaggcgttacctgtcagttcctatcggaggcgactagataggttgacgaccgacgctgtctgttggactccatacatcgatcatcgtccggtccgtccctttgaggtcatctgtctctactcaggttatatttgatggggtccttactgtgtcaggtaccttccagagagggtactcagacagtttggcttcattcagaccatccccattctcctgagcttgcccaccccgtcagatgaagaggtggatgacagctggcttcattacgcccaccatcttactatcacaggacccccttcccccggccagtgcgaggctgcatacatggactggttctaccggatatcacaccctttcatgtgcccgcctaagcctggggaagacagagcgcctcctcatgtgccagttaccacagatgatccaccatctactacggcagaccccacgggtgacattgcagctgatcagcctgacatgcctcgacatgcaatggtaacacaaatttgtaatttattctcgtattaaaaaatgtttaacctgtgttatgattataacgaccgcttacacagtttgtctaatttttattgcaggccgcattcgaaaccattgcagagaggttgcagaggcttatagatcttcgcatggtgacctctggcaccgatgtgtacgagactgttgccaactgtgttacattagcacgcagtgtctgcgatgatcggagagtgtatgttcgctcgagacgtcgtaggactggaccgcgtggagattgatttgttactttttttgtattgttgacaacatatgtattaacattattgtattgttgaaacatttcatttcatatatgtaaatgctttttaacattatccatctgcgacagtattttgtcatgcgaaataacagaatccagcagttaatacaattacataaccccctgccatttagttcacaacacatgaaaacattacgtaaagtcaaagcatgtcagaacccagatcaacataaactggtggcaatgttgtcaagcttgtatacttcttcagtcgactaatgtaactagatggccactcatttgcttgaggctgacaatgtcttgaccataataatgcaattggtggcataggacagccatctcgcaatgcaacctgaacacaaaccgttttattgttaatgtacacaagtcaaatgattagaaacacataaaacgacattagttgtacctgaacaaaatggtttccatatacatgaccgatacaaatgacgcgatgtcccgcaggatctctaggcggttggcttctaagcgggaaaaaagtcatactttgttgcttagaaagacaaacaagaactaggttataacgtgaagcaattacataacccatgtctgtaacatccatccatttatcctgtgttacctgcattttaacaaagtataagtgttatgcaccacaacaatatggtaatattgtcaatcacagacacaagtcacatttaccattgagaatccgtccacaagtagtgatctttttaagtcctcaaatctttgtaacccaccaaacaatataatatagtctgcagaccattcgttaagttccttaagcaaattgttacgaaccacaggccacccatcttcaccaaaacccagtagagccgcaataacccgatatccacaattaccatcggctttaacatcacatacaccaataatgtaatttctcatgcacggaaggaactgatccagcattggaatatcacccatcggtgaagcacctgaagatgttgaagcggactgtggtacagaggagcaactatcatgttgagaatgtaatgcgtcgacgtactcaaagtacgatggatctcgctttgttgatctttgatacttggtaaggtttttcttttgagccccttttgtcttcaccttttcaggaggaggacacattgatgtttgatcaggatacgcaatttctttcaatttagtcttaagagtaactttgccacacaagtcaagactttcaaatcgcttggatatcacttcccactcttctgtgatggtcacctccatctcatcaactgatgagtccgacatatgcaatctccgccaaaacatgtgtaccgtgcccagtggtatgctgctaacattatactttgctaactcacatgcacaaggcaaaccatgcgtacttcttaacacacatccacaacgacaactatctacacctacatgcttaactcggtctaactctgcggcaatttcatttaacgcatacctggaaaccatgcctacgagtcttttgtataacgtggttttaaacatatgtccaacaacatgtgtgcttgtctcaaaagaagccttaatctcattgtgttgtaacgtgatcatgttgttcatcgcatcctatacgttacacaaatctccaagactgtcctgcagtagtctctttaaggtccaatgggcagacttaaccctgtagtaaacggttaaaataacaccggttaactaaatgatgaccatgcagtataatgtaattgtaaactttctattgtaaagcatttacctgttcgtagtggtgtggccaaaatgcatcactttattagtccaggctgtgacaaatcgttctttgtgagggatcaaccacgtgtctttcacatattgaacaaatattggccatggtgcacaaacacattcaaacctcatcagacactcatcccattcattttcaaaagcacaatctaccagacttccccatgcttccatgacaaactcccatgaattgttttgtcccacgagcgttttacatttttccttgacattcttgtcaatgtggaaccgacacaacaagttcattgtgccagggaaaacatctttgatcgcattcatgagggctgtatctctgtctgtcacaatgacatcaggaaaaaattcagtcttcaaaaaaagccctctaaatcgttcaagagcccatacaagattgttcgtacgttcgccctccaaatatgcaaaggcagctgaaaaagtcatcccggtaggtgtcactccgactatgtcaaccaaagggagtctatacctatttgttttgtatgtactatcaattaggaaaaccaaatgatatgaatttatcaacttgactgcatccggatgtgcccaaaacatgtctcggataacattttcttccttcactctatgccagtggacatacatatcacgatgaagaagcttcattaaatgttgcatttcagtattgttgcctcttatagaagtgcggtatgcatatcttgcattgtacacttgtttcattgttgtataacttttaggattgcgatcttttaaagtgagcataatatttttgggtttaacccttgagtttgtcatatcaccaacaattaccttctcttcctcagttaaacgaccagcatatggatgtccagtgaatgacttagccaaacaatggttgtgtaacccgcagattaactttaccatccacccttcaccacctatgacgggtttccctcgcaacttaaaaggacacccgcattttctactgctagtggtcatgcgttctaaatctttgttgaatgctctatactttccactcctttcacaacctatcaaaataaatgtggtccttcccctcttaccagttgttgtgtcagacctcattatcacagctacaaaaccaatctcatgtgcaacactacgagcccattgcaatacctcgtcacgagaattaaacacctacaacatttcagaatacatgctcaatctcatgaaattatttatttactgacattcaatatgctactttatcacataaatacctttgaagtcttaaatgcatcagaacaatcaatcacagaattctcattctcaaatgcaaacggttcacctctattgtcttcacccatattattttcttccgccataatatcatcatgcatccaatcatcgttatccatcttaataaacaaacaaattcaaaacaaataatcattaacaaaaaatatggttatattcatttcacaactttgtgattaattcaaaacaaattttcctcataattcaaaagttaatggttattttaattcaaagaggaaaaatacaataattattaattccttttaacaaaaacaactcaaaataacaaaaaaaaaacccaaaatcaaaacaaacagaaaaaaaagccatacggattggcaatccgtaggagtcacacggattggcaatccgtaggagtcacacggattgccaatccgtgtgactcctacgaattgccaatccgtatggtttctgctacaatgattagttgcagaacgtacttccgacgacggcagcggccaatggaagctccaccaatgctaaccacgacctcccgaaccaaaccaaccacgcaagaggcaccaacacgcagccaacaaccaacagtgaagacgcgaagaagcagaaggcgcatggaagaagaaaatgaagaaaaaacctgctgggtgtatgttaaaaagcaacaagggtagtattgccattttttaaaaattgctgggtgtattagaaattagctgggtgtaggaagttaaacccttcctacaatgtgtgtcacataccttggattagcccaaggtgataggaacccaaacatattgttttgggctgcttcataaaaagagacttcaactaccatagaccaaagcatacataccatgattcaaccgaatatcactaccatgatgacatttaacatcaattcatccacatctacttatgatactcaactaaactgctagtaacacaaaggaaagaaaataaaccagagatgagaaactgatctgaataccagacctagttgaaaggtatttttcaacatgagaacaaagacagttcatacagggaagtaacaaaataacaaaacaaatatcttgtattttttcatctgtggggatgatgcctggtctcatggatgagaacaatcaatacaattctcctagactttatgttaaagcttacggaatggatggattaccctacgtttttggattaaaatcctcgaaaacaatggatgagaaaagcgagtttctatctacagtgagaggcaaccaaacaaaagttaaaatccagagaccagggagagttgttgtctgggatgtcataatactaaatactttcaatcccattattaaattttgataaggttaacccataatttcctttaaatatgatttctgtttttcttttactattatgaactaggacatgaaagaaaagaaatcaagcacacatgaaactgtagtgtagacacgtttaataagttattctcaagcaaaactgcacctgatacagtgacacaaatatggaagtttctatttgagatggttttacctttgaaacccaatctaagcctcaataccaaacaaagaaaataaaggtaggcatgaatgaagagcaagaacagaaaagtttaaggaataccgtgaataacctaaaaggaaacttgtagatgtaaaatcattcaagtaattaaaaattgtgaaactaatcattccctcacaatccttcattgctgaatctatggttcctttcctttaatcatggagatcaacaaagcaagctatgcttttaataactaaaagccagaagtgcaaagtcatagagaaactaataccaagccaccaacccaggagttcagttttcaaaagaaaacgaaatctcaatctactgaggataagatgtttggtaataatgttgctgaccataaccaccataagcagagccactatcataataaccagaaggcataagtggttctgatgaatttggaagagaacaaccttgaccaaggttgccactgggacccattgggacaccatcaggaccataaggcccagttgaagcgcctgcattaggcaagatggatattcagattgaagattactacactcaataaccttaattgccgatttcagtgcatggatttgtctcgccatgatctcactctgcaaaaacacccaaataaatacaggcagtgacaccatagaccaggtaaccaatcaagcggaggatacttacaagtgacttcccttcttcggaaagtcttttaacagtttctgagactcattcacgtgagctttcaaaatgggaaccggtggaatcttatgagcaagattgaactcaaaaacaaacttgacagccaaaatatgtttgctcctgtcaataactttctgcacaagacatgcgtaacacccaaaacaaaatttccctcacaaattaaaccaccaaaaagtgtaacactagaaatcaaataacagcagcatcaccatttcaaattacaaccttgcaccatttttgttattaaaaaaaattccaactccagaccacgcaacataaacactaggggcttaatgatgtttaagaccctgaaaaatggacatcattagtttttgtccgtgactttcaaaaccattagtttccgtccatgtgtttttttaaatatccaaactttaatcctctaaagctaaaattgcaagggactaaaatattatgatattaggggataaagtttggatatttggcaaaacatacggacgaaaaattatgattttaaaagtcgccaccctaaaaccaaagatccatttttgatggaatggaaacaccataaaccctaaacactactgtaacaacaacagttaagaaactacaagtacaacaaaacaaaaacacaaatactgtaacacaataccatctcctaccagctcaaataaagcaaaaaatcaaattcaattaagggattgcaacctggaactaaaaccaaagatggccctcacagacttaaaacaccattaaccaggggtgtaaatgaaccaaattattcatgaactattcgagtttgactcatcaattaatcgttcaaacttgtttgattaattaaaataaacaaactcgagcttgatattaagcttgaatatttaaatgagtcaagcccaaattttaaaagcttaatattgatattaagggctcgtgaatagctagtttatatatatatatatatatatatatatatatatatatatataagttttatttaatcttatactagtatttatttatgatagattgataattttcattaaaaatttatttacttttataatttttgagttaaattagaaaatataagataagattaaaaagcaaatgacgtttcaattgctttgagctttcccacttacttttcttttgcattgtaactcaaaattttgaagactcttcctttgccaaatcaagtttttcatcttcaaagcttttctcccaaattaaaattccaagattataaatgagtcaaaaaaaacataactgaatgcttctcatagtaaaaaaaaattctaccgaaatcgaaagtaaaaaaaaaaatgtttcaaaggattttttcagtttccacatacaaagaagcttttcgtggaaataaaaattattttctagaaacatgttgtagtaaaattccaaatccttttcattaaaaaatggataattgtaccaaataacaatattaatcactgtaaaaataaaaataaagcaatggaaaattaacatacttgaagttgattggtgtcttgcatgagaggggtccgtcatatttgaatagttgaatactagaatagaatgtgaaacaatgagtgaaggaatttgaagcacctgagattgaatttgaaagtgatgtagaagagtggtccactggcccggtagaaagtgaagtggaatttgaagcacctgaaattgcattgtaactcatttaacaagccaagcccaagattataaatgaatcaagctttagccattaatttttttcaatgatcaaacccaaaattcaagagctcaattcaactcgtctcatttacacccctaccattaaccctaaacactagtgtaacaattcataacaacagttaacaagctacaacaacaaaacaaaaataaagtcacgtcataatatcatttcttaccagctccaatccaaaattctgttttaattcatttcggataaatagtcaaattcgtcttcgaaaatatgatgtggtgacaaattaatacctaaaaaatgaaaaatgaaaaatttaaatttaattcctaaatgtgtaaaaagtaccaacaaattaatcatttcataagcgtgatgttatttgatgttatctcatgaaaaattagacttattgagcttgtttcgttccaagttaaacaaatcctattacagatataggatattagtattactagggttgactatataacctacatttgtactcatgtaataatttttcttatttgagtaaaatatacttttctctcttttctccccctgacccatgaattctaacaagcccttatcactccgatcgggatagacgggtccttgagctatttttttagtgaagggtgttaatgaaaatctttaagtaaaatagtctgtgaattgataatcaaatggagtcattacaaacatacgtctattagaatacgagacaaaaagaatcggaggggataaaataaaaaatgagaacatttgatcacggtaaaaaatcataaaaaaattataaaaattaaaaacgaatgttgatataattacaagataaaaaatatattcaaacctttggacaaaatctaagaagataatgtttttttttcttctctaattcaaaacttactttttttagtcacagtaccaaactcacaactcctactttaaccaagcacatttaagcaacgacctgcaaaaacaatagtaatagtatctgaattaaatatgtgttccagcttaggggtgttattggattaacttaaaaatggtttggatcaaatctaatttaattcaattaagatatgattataaatggattggattgtgagttttattttttattcgatccaatccaattcatatcatacattttatttattattatatgtaaattaattattaaatataaaatacattaatttttaactcataatttattaattattaaattaaaaaatccatatttttttctttttaagttattatttttatctctatcttgattttatttatattttcttatgttaatataaaactttatttatatctaaaataaaaatatcatattaacatatatttagtagttatatatttataaaattttagataaaaataaattattattctaaaaaaatatttttttacaaaatatatatatatatatatatattcaaatatttagactcgattaatctttgaatagattgatttgaatcgaatttataaaaataattgttaaaactcaatttaatttgcaaaattttcatcagattatataatgaatttaatccaatcagattaaatcctatccgtaaacaccctatcgaaccataaaataagattagatacgctgttggttttttaaataaagaacaaagggcaaaaaatgcatggactgatgaaagcgtaagtgagagagaggaattggttttgaatttcaattttgaaggtatagtctatagtctatagtggaaggctgaatcaggaaggaacttatcctactagtgctgtctgtcaacgttactcacttcagaagcattatataatagaatgagccaaacaacaacgaaaacgcgttcacttcaaagttttattttaaaattaatattattaaaggaagggtacaaccaagacgcgttcaatacccattctattctatttctgctccctccatacttttccttactccactgcctattatttaaattacatagctcttagagtggaacaagtttaacgggtaataaccatttttaatcatcattgattttccactttcaattttacaatattaactataactattctttcccttaaataattcccaataaaaaggaaatgaactaacttgtaaagctttcatagaatgaaatacaattaatagcagttacttgcaaagaaggaagtcaagtgtcttgttttaacaaaatttaactaccttttaatttatttaattaaaattattttaactggactatactttatttaattaaattagttatgtttggtaaatattattttactaacttataatatttttgaaatgttttttgaatttgcgtttgaactcagtttttttaccttcaatattttaagaaacattttcatttatcactttttttaatgttatattattttttttaacaaaaaatagtttttaataccacattatttatttttattataacagaatttgactttcaaacaaaaagtaaatgcttaaaattaattaaaaaacaaaattctaattatctaaaaatatattttgtctactaaataaaaaattatataaatatactatttgatgtcagataatttgattatcaaatacagccattatattgtacaagatcctttaattcatataaatattgaatggctgattaaaaaaaaatcaatgataagtgaatagtcatgacatggacaacacaattcatgaacatactctttaattcattaactttcttgcaataatataattgtgtggtatgtatatataccttacgtgtttagattttaaagattctttttgttttttaaacagattttaaagattctgcatgtgcaaatattaaaaagactgtatgagataaatgtgaggtgcaatgatcttctatgaaaatggtcactttaaaaatgattgtgttcgcgcctaaaacacacactctttgcatcttcttcaaaccttataggctttatcgcccattataactctgcatattcatatccatgattactaaaatgaagttcgttgtatgcaaagattttgagctagctgcatttgaagatggattctactattctagttctagggtgaagtggcattaatttttatcattagatatataactaaaatattgggctgagattcaagaaaggaaactcacttaatcggttattttctaattacatttgaatgttttataacaattactttatttttctttatgtggtcaacttcctgccacccacagcccaccgccaccaccacctccttccagcactcacaatatgcaattcattccaaatttagtttccgtaaatgcgataagttattaaattcataaaattattttgtaattaattatattatttaagtatttatttgataataaattatattttaaaacattaatttgatattaaattataaaatttagatattaatttattattaaattatctaaagaattaatttctcacatttttatacatttaggagttaatttaaatttttatcttttaagattaatttgtcattctttcacattttcatagacaaaattaattatttatcaaaaaataataatatttttaaccaaaaacaattaaaagtttacccgttaatgaagttgcttttctctgacctctcgaccataatgtgaaaaaaacaacaaatagatcggtgttattattaaatttgtgaaaatattttattattaaatgataacaaagattaatttaataataaattttatttttaagttcactttaatattatattacaaaattaaagaatcaatttatcattaaattattcacgtaattaatctttcaaacattttattttaaaactaaatttaaatttacttttttaatgcctaatttattatgtctcataaccaaaataaaatattttaaaaataaaaagacctcagccattcaattttttaccactcacattggaagaagccgccgactttgaccaaagagaagaatgagaagaaaagtcacactttcctcccttcttcctttagctttcccgttgctgctgtgctgtgctgtgctgacaataaaaagggccacccctttctccctcttcttcattcttcgctcaatcgaggtcttctcgatttccttttctacaacacaacgctctcttctcttgcaaccaaaatacttgttccagtgtctactctactcaaaaaggtatgtctttctttccgtgcttttactgactcatacatatatatttttttttgttgggtgttcttgtttagatctttggttgttttgggtgggtctgaggaatatgcttcgtgggtctgcttctgggtagattaaagtttcaaactttggttttatattttggcagttgcatgttttcgccccgacccacctttcttccttttagttccttattaagtttattggaataccaagttgttgttgtcttggataggattagttatggatctaacctttgttggtaaaattggtattaacacgttttatggggacgttgcttagctttgtatctgtagggatttgaactagggtttggaaactctgtttctaaatttgaggttttatcgtttttctttattctgtgtgaataataaattataaattgaaaggcttattgagattacgttgtcttattctgcaggttttgggacatcatgtgcagtgattcgaaaagtaaactttcttccccaaccctagtcgtcatggagagtagtaacattcagaagcagaatctggatggtctctacaactcggttttgcttgaattgtctgcatctgatgattatgaggctttcaaaagagaggtggatgaaaagggcttagatgtgaacgaggcaggcttatggtatggtagaagaattgggtcaaagaagatgggatctgaaacgaggacccctctgatgattgcttctttgtttggaagcgctaaggtgctcaattatattcttcttgagaaaggaggaggtgttgatgtgaacagggtctgtggttctgatagggccactgctctccattgtgctgttgctggtggctccgaatcctcacttgagattgtcaagctcttgcttgatgctggggctgatgctgagtgccttgatgcgagtggcaacaagccggttaatctgattgctcctgcctttgattctttgtccaaatcgcgaaggaaggctatggagatgttcctcaggggtggtggggaaagagatgaactcatgaaccaggagatggagttacagatgttttctgttccagagaaaaaagaaggaagtgataataagaaagaataccctgttgatatatcactgcctgacatcaacaacggtgtatatggaacagatgagtttaggatgtacaacttcaaggtgaagccttgctcaagggcttactcccatgactggaccgagtgtccattcgttcatcccggggagaacgcgaggaggagagacccacggaaatacccttacagctgtgttccttgcccagagttccgcaaagggacctgccagaagggtgattcctgcgagtatgctcatggtgtttttgagtcctggctacatcccgcccaataccggacaaggctttgcaaggatgagacgggctgtgctagaaaagtctgcttctttgctcacaaacctgaagaactacgccctgtgtatgcttccactgggtcggctatgccatcaccaaaatcctattcagctagtggacttgacatgacagctatgagtccattggctcttagttccacatctttgccgatgccaagtgtttcaaccccacccatgtctcccttggcagtagcttcatctcccaagagtggaagcttgtggcagaacaaaataaaccttactccaccatcgttgcagctccctggtagccgactgaaggctgctttgagtgccagggatctggagatggagatggaactgctcggtctagaaagccctgctcgccaacaacagcagcagcaacaacaattgatcgaagaaattgccaggatctcttccccatcttttcggagccaggaattcaacaggattgttgatttgaatcctactaaccttgatgacctgttagcatctgctgacccttctgtattatctcaattacatggactttctgtgcaaccttcaacacccacacaaagtgggcttcagatgcgccaaaacatgaaccacctccgtgcgagttatccatccaacatcccttcctctcctctgaggaagccctcagcttttgggtttgactcatcagctgctgtggcaactgcaatgatgaattccaggtccgctgccttcgcaaaacgaagccaaagtttcattgaccgtggagctgcaacccaccatcttgggctgtcttcagcttccaacccttcttgcagggtctcctctaccctttcagattggagttcccctactgggaaactggattggggtgtaaacggagacaagctgaacaagctgaggaaatctacttcctttgggttcagaaacagtggggtaactgcatcccccatagcacagccagaatttggtgctgagccggatgtctcatgggttcattcattggttaaagatgttccctccgagaggtctgagatatttggtgctgagaaccaacaatatgatctcagtaaagagatgctttcaccatgggtggagcagctgtatatagagcaggagcagatggtagcatgagcaagggctgccatggcaatgcttcttggttattctgacaaagtttatttatttatttaattattttattcatttgaaatgcttctactatccaatattacaaaatatagttagggataggatgagatatgttgcaaagaacaaagttcaggttaatccagagatttgaacgggagttccaacttctagaagatcagggaagacttggagaaacgttgaacgaaggatgctgaatttttatattgtataatataaatttataacccccatttctctacggatggatgtattttctctagcaagtggaccccaaagtagttgtcattgattaagcagcacaattctttttttatataaaattgttatgccatttgatcaatgcttatccattactagaagtagtttcaagggaatttcttgtgtgtctgtttattgcctattctttcttatttaaatacttgattccttgtggtttaatggattcaaattcttcaaatataaatcgtgttcttatttagttttgattatattgagcttgtaggatctgtatcctcacggttttcccccctcaggccacacagagatctgtttttctcggcataatattcttcgtttgagattttttttttcctctttatgttcttgacggtttttttttaaagaggagttttaacacatttgtctctttcaatttctcccccttaaatacaaagagaggtcagccttttttgggtccagtaataacctgttctccccgccccccaaccagaacacaaataattaaaacatgatggcttctttcctgttgggagtttaaggaaaaaactagaagtaaacttacaaaatatgagctgacttgtattcttcctattttttttaaaaaaaatattctaaagaaactccagaagatcacttaatataaagaactttgaatgctgttttgttctttttttcccgaagggaaaaattcatagaaagcctcacaagtaaagagaataaaaaaagattgaaacacactgtaaaagatcaaacttacacacaatttcatgtcccgcaacttaatcaactgaggttactaaaggagagtattagatacttgataggtatggagttgagaatgagtttcaaatatttattgatttcttattttataataaatttttaaaggtccatcgatgaacagctgacaaaatgtttgaaaaaccattttcaatgttacatctaagggtaccaaaggaaaatagagtatgtcactttaattggttacagtagtactatcaaatattttagaaaaaacaggtcatggctaacccttcctttctggagcattagttggcacttgcaagttggaatgcaataggtaaaaaaagtatattcttaactgtaaaatttcttatgtatctcttaaattgcaataattttttcagccgttggttcaagaaaaaatttgtatattgtggaaatcaaacataagatttctatttaaataaatcgtttcctcacatttgaatacagctgagtcctacgcctttgtcaatcttgtggtttacatgtattccataggtgcaaaaaattgcaattatctgtacagataagatacaggttttataaaggtgtcgacgacggctcaataagaaaaggaaagagggttggaaaaaataaatggtgtgaaataagtctgcttcagatttattttaaaaaaattatgtataaaaagcactcccatttataaatataatacaagactttatttatgtatgccattatagatagatagattcaactttgaaatgaaggcaatgtcgggaaatgtagttatccagattagagggttatgtggcgaacagacggtccaatggtccttataggtagttgagtccttcagagaatgagttggtcttggtttagagtttgtttgttagttcatcaacccacgtgcttaaatttgtcaaggataatgtttagggcacattagcaaaataggcaaaaaaaaataaaaatgtatgaagtacattttgtataaatttgatatgatataaacgctgacatgatcggcataaagtacacacgttatgtataatcgttaaattttatgcaaatttgtgctgcaagatattaatataaaatcaagagatagtaaataattgaatatgctcctatcgtcacaatttgtgttatcttctaaactgaacttatttcaggaagtataatggcaaatgaacgaaaattgtataaataaaaacatgccgcacaattaaatttaaacttcaataacaaatgtgaagttaacttacataaatctagagatatgttatgatgattttctgcgttgtttctctatcacaaatttttttaatacaaaatcatagcatattagatctgcccatcagttaagttcataaaaattgtatcttcataattctctctcaagtgaaatggccatattttcatccaatttcatcaataaataactgttaacactctgatccgcattttccgctttaaagttcttagccatatatattaacaaagatagcatacgctccatatagcaaataagttgaattacaataatgggagaaatgaacaaactagagctgtctttccattcatttttgctttggagatagacttgctgtagcatctaggtactgcagctgcaagaacttcatgttggaaaccaatgagacaatagatataattttctcaaacattttttgtagagagactgatcacattcagcaagcaaccacatgtaggttgtcccatgctctcttttatagcagccctcaaatttaatttcatttaatttgtcataagaagctttgctatatatgttgaaacatttattcaatactttgaatacgaacaatagtgatctagatggtggggttaagaattgatgactaatttctcaatagaacatatatggccagaaaagggaggaatgatgaagctattggtacaaggcatgaaagataggtagttattttaaatcattgttaaactggaacattggtgattcttgcaagaaaataagacaaaggaggaaacagaataacaacttcaaaaagccttccactagctaggtgaaaaggaagaaacagaataaactggaaaattttcttgataattgattttacgctggggctcgttgtcctgcaaaccatattccctgtcacggtatctccaataaaataaaattaattcatgcataagttaaaaattatccttttttggaaagaagttaaacttttttttaagaaactaatatgagaacatttgcaaattagtttggaaaaaagtttatttaatttttctttcttattgtcttttcctataaatttgtatagaaatctttttctatacaaacccaaagttaccatatggtaatgttcaataatacaatctcaagggggacaatgtagcaagaggaagaagaaaagaaaagaagaataagaagggaagaaacagttggatatgcaacatgatcttagtaataatgtttctgatagtggaatcagtatatgcaacagaaaatgggctgaagaggggcgtatcttatgagcgggatgaaactgttatgaaacagaaaatggtggagatgaagaatagagatcaaatagtaggaagtgaaaagataaagatatgttatgaggagggatgcagcaagggtccatatgagactaatgatatacaatgagcaggggttgggggaaggattaagtgaaagtttattaggaatgtggtggcaaaggagaacattcaagtgttgtgcattcaagaaaccaagatgctggcaaatggtgatactctatgcaatgctctctggggggaaaatgaggcaaaaagtgtaacaagtccagcaattggatcagtcgggggattactttgtgaaactcggaaagcttggaggtagtaagttctttttgtggtgagggttatattggcttggaggggatttggagagacacacattctttagttactattgttaatgtatatgtaccttgtgagagacaaaagaaagttaaattatgggaggaacttactacaaaaaaaagggccactagcaatatcaagtgttggtgtatcttgagtgatttcaattgtgtaagaagaatggaggaaagaggagtgggagtgggagattataatagaagtgagagggaggctttcaacaactttattgaagattatgactctcaataaccttaatcgccgatttcaatgcatggatttctcttgccatgatctcattctgcaaaaacacccaaataaatacaggcagtgataccatacatcaggtaaaccaatcacggggaggatacttacaagtgacttaccttcttcggaaagtcttttaaaaagtttctgagactcattcacatgagctttcaaaatgggaatcggtggaatcttatgagcaagattgaacttaaaaacaaacttgacagctagaatatgtttgctcctgtcaataagtttctgcacaagatctgcaaaacaccaaaacaaaatttcccccacaagttaaaccaccaaaaattgtaacgctagaaatcaaataatagcagcatcaccatttcaatataaccttgcaccatttttttttataaaaaaaattccaacttcaagatcacgtaacataaacactagggggttaatgatgttttaacaccctgaaaatgggtaatctttagtttttgtccgtgactttcaatatcattagtttccgtccatgtgttttagtcccctaaagctaaaattaggaccttgtgagagacaaaagaaagttaaattatggtattaggggataaagtttggatattggctaaacataggcacgaagatcttaaaagtctgggcctaaaaccaaagatccattgttttaggaaataaaaacgccattaaccttaaacactattgtagcaacaacaacagttaagaaactataagtacaacaaaaaacaaaaacataaatatcgtttctctaaatatttgtataatattagtaattttcatgtaaatatcaacataagataacaaatatcacaaaaaacagtaaaaacactaactttagttaattttataaagattaaaacaaaataagtgcataaataagattaaaatgatctttttgtggttttataataaaaacaaaactgaaaataaaagatttaacaattaacaaaggtattgtcgggattagacttcaccaaactctactttcttttcactttaatgcacaacacatattccatttgtatttcaatgttaaaatcaatcaataaatatctttgtagctctgatcccttagatgaaaaaagtcttaatttctttattaagtcttgatccctcaacaacttaagaaaaatgacacaagataataatgaactaagcttcattcctaaacaacaagttcattgggtattttgtttcagctctatagaatgaagacattttcaacaacaatcatgtcctaaaattatgtcatggttgaccattccacaacaagcattaaacaaagaaacaaaatattaacattgaacacaaacatacatacatacatatatatatatatatatatatatatatatatatatcgaaagagagagagagagaaaaaaaattacacaagtgtaactttgataactattacatcattctataacttataactgaataatgttttcttaaaactcattgtttgattgaaattttttcccacttatatcacatatgcaaaatttcatattaattcaaaatcatttgttatttcgttcatatatactaaaattgacttaatataaacatttcaaatatactaaaatatgaataatttgattacccccttggtgttgtttaattttgacatatacaatcttaataatatgtagatataatttaacgattgaataaaaaaaatcacattctatatcaaattataaaaatgatgtaaaaattgtcaaaattacacatatataatttgatctctttttatatatatatttaccaagatgtacaagagagtttgagtaatgtttcacctacttttaacaatggagaaacttagttacttatagcaatgagtagctccaaaatacatgaaagatggaagagaaatggagaaaaggacccaagggaaaaacttatctccaaaggaatagtgagaacttcgtgtctctagacaaaagaaaaaaaaaatgaaggaccatcctttattagacaaacatccactttaaatacataagaaaacttttcatttttggcaacaattttcgcttaggcataaaatttggtttagttagaatacatagatctcaaatgaacacaacaaaactcttgctcagccatcgattcttgcttagtcaggcttgaaccttttgttctctatctgaattttagcttagcctaaaattatggcttagtaactgtaacgcatttccttacattttttcaagcttttgctcctaattttctttccaacttcaacctctatttctacaaaaaggaattagaaatacaaagataactacaaaataagacaaccaactaaaaagttaaaactttataaaactagattaaattgagtttaacaagactccaaataagaagaaaagtgagatctctaaatttactcacaaattaagtatcgtagacaataatcagatgcacaataccatccatctcctaccagctcaaataaagcaaaaaatcaaattcaattaagggattgcaacctggaactaaaaccaaagatgatcctcacacaccattaaccctaaacactagtgtcatagcttacaacaacagttaacaagctgcaccaacaaaacaaaaacacacagttacaccataatatcatctcctaactgttcaaatataacaaaaaattaagggacttcaacctgaaactctgtctcatttcatttttttttttttaaattttttttctccaataaatgtttatgatttatccaatcagacactcaaagatgactatttttcaaggactaaaaacaccaacaatcctaaacactagtgtcacaacaacagtacggatatgaattgggccataatgcttgggctgctatgccctgatccagtacggatattaattgtatattatttggttaatatataattattgtagtataaattttaagaaataattgccgattttttgaaaactttctcaacaagttaatggggaaaagttcccctaaaataaactgaaacaaatatacaattaccaatttaccgtaatcattattggaaatcaaatcttgagcttaaagtgatgatccacttttcttttcgttcgttggcaaatggcacctttggtgattcaaggcctttcatgcatgttgaaagggatggtcatatgatacaagtaattaactcatggatgaatgaaagggctacacggacttaataactctaactaaaaatagcatttccccataaaataggacaatttccaatgaaaagaatcacattattcttacgttgagaaaccatacggaagattttggaaatgaaagttattcacatattttggaaataaaagtcatcttcacgcgaagcacatcacaatattttggttaagatattttctcccataaatcacagcaacaaagtttggtaaaatctttttaatttcttttcaatggtgttgtaaagccagcaaccaattaattattttaattccttttcaaaatatttcatcaaattgaggagtagaaatcattaatcagggaaattaagatgcatagaacccgcaatgattttacatgatcttggacaatccctccatgcacgggatggataaagtcgaagtacaatgttttccaataattttaatatcttattggtataaatatttgaaataatattacttgtgtttagtctttgttatttgagccacataagatttcattcaataataaaaagagttaataagattattagggaagcaataatccaaacgaataaaaatttaaagaaaaaatcttcaaaataatatatggtttgactgatataaagcattatttgctttatttataagaattatttgttttcaaactatatcatacaattactatatcaaatgcgattcattcttttataataatattttactgtaataaaatggaagaaagggcaagtggcattgacgaactattgttaacttcaaactattacttataatatgcttagtcaaaccttaaattttgaaattttttttagtcaaactactaaaaaaaaacttatttaccgagaaataaattttttaattagtaaaaaaaattaaaaactaactgaaatgctacttaaagaattttttttttattttcagttttaaaataatgttattaatattattatttatatgttaaaaaatgttttaagcaatataataatcaataataataaagtttttttaatttacttttactttttcaaaaacaaattaaaatttaattgtaccattttttgtaataaagttcaaaataccaaatacattcttttacatcatttgatatttataagtcaatttatcagttaattttattaaatacttttaattagcttataagtttttaaataattttcaacttttcagtttataacttataacttataaactttcaactgattttattaaacatagtctaacatacacgttattttatatattgataattttataaaaatattaaaatttaatttaaaataaagataaaaatgataaattaataaaaaaagttaaaaaaatcctttaaaaacattatagtagaaaaagttttcttaaaaacacaagttttgttctaataataagattaactttttttctcctcaaaacaagatatttctataatcgaaagtcatgagactaatcatgagactaatcatcgaaacataaaaatccgattttatctctcccgatatgttttttttcatatgcaccatttgagaatctatctctatgaacatgtttaaagaatcaaattatctactaactctattatatcttattgatagatattttctttctacttacattgtttaaatatcaaataatataatcacttttatctctcagttttctttcttttttcatgcacatagtatatctgactttaattgttaactcttttttcccccagttctctttacttggattcctgtcaacagcaagagaatgtgattctgaagccacaacctgattttgttatttctttctaatgttttcttttcttggaaggtaacctcttccccattacctggaaagctattagaagcacctcaacacgctcatccatcattgtttgccccgcacgcgctgccgtcaaagccttacgcgttgacccacaaaacaaaggtttatttgactttcctcaacacccaaaaaacacgatgcaaattgcaaacccgtttccttagttcggcacttcggctttaatattattaacaaatcttcatttacattttttgatacagaaagtatcaattaaaagtaaatatattcgatatcttaaaatacttttttttatgtttaataaatagaaagaataatacaaagatattatagaaaattcaaaaattattctctagacgttattataatgacataggaaaaaaattctctttcatttattggaatttacccatagcagagatatagacacaatgtcggaaaatttcactaaaatgagagaatctcaatccaatggcatatacatctccaatgagtcatgacatgacaatgatgagtgtggttaaaagacaatcaattcgtttgtttttttttttttttttattaatttgtctccctaatcttttatttttaaaagtcattgaattttaagtaattcaagcagagtaaaataaactcatttttaaaaaaattctactcaaacttctttttatttacaaaatttgaattgaatacgtaatctcaatttaaaagaatcaagtttttttttgtggttgatataatttttaaaataatttttaaaaaatcaactaacttttcatgaatggtgagttttgttcagatgatagtatcaaattatttttatatttgttactatacaattttaaaagatatagaaaaagttgaattcgaaaaaagataaaataatgatcaaagaaaaccgtcaatactttatagtttgaattaattactcctcaacgctgcatctttaataattataaatagtcacatttacacgtctctgacctctcccctcattttttgtgtctgatttgaggttggagcgtagtcagcttctcttttctgccgaaagctgcagaattgtgttgttttctctcccttgggggtcaagcaatcggttctcttcatggttatcaatcttatccttcttctttcatgcattatattcattcatttaccattcttctcctaaacaactcacatagcccaccagatttgaagtattctgtgtgtgtttttctgttttacttatataaatatctggtgagaaattattgtatggtttgatattactacatgtttataagttcagccaatattcatatcacacataatcgaattttattatctctttttagtgaattgaaaaacttgttcacatggtaagagaagattgaccgacatgaaaacgtgatataataaaaatcaatgaattaatggctagacttagttgcagaaaattattttttgattgatttttctttgataattttcatctgaagacttcaatggggttgttttgttattgttgttgtttgtttcctttttcttccacaaaatttagtggcatgctgaatttgatttgatatgattagattttgccgagtatctgattggtcttacatgtgatagatgccgagtgttaaccctgacaaagattccgagccatttgttgagaccgatccaactggtcgctatggtagatacagtgagttgcttggatgtggtgctgtgaagaaagtgtatcgtgcatttgatcaggaagaaggaatagaggtggcatggaaccaggtgaagctgaggaacttctgtgatgatcctgccatgttggataggctttactctgaagtgaggttgctcagaggcttgtccaacaagaacatcattgcactttacaatgtgtggagggatgagcagcgaaacactttgaatttcatcactgaggtttgcaccagtgggaatttgagggagtacaggaagaagcataggcatgtttcgataaaggcactaaagaagtggtctaagcagattttgaaagggttgaattatttgcacttgcatgatccctgcatcatccacagagatctcaattgcagcaatgtgtttgtcaatgggaatactggccaggtgaaccattttattcaaatcttattttccgtccagttatatatcatatatgtttgattgattatcaaggtgaaagtaaactaccaaaaatgcaagaaaaagttggattttttttcttctttttcttaactttcctttgactcgatgccttctgtgtgagatctaagtaattaacttgagcaagtcatggatgatgtctcctgtttgcttgacaaaaacgatcaattacattgtttttagaatactaatttggtgcttacttttttccttgctctgtttttgcctataaatttctactatgaaaaaatatgagaggtgaaataagtgatgcattaaaactataatagggcaagaagatgggatagcataagaaacaacacgaataatggaaaattgaaagtaaaaaaccataatagtctaagatattttgattttaaactatttttggaaactattcttatcaaacatttttttggtttagaaacttcaaacttgtttgcctttagccactattacaaccaaggttaatcttagttatgctgttgttatatatgtaattaacataaaggttttgttagtgattgtatcttttttcatggatatcaggttaagattggtgacttggggttggcagcaattgtgggcaagaaccattgtgcacacacgattcttggcacaccagaatttatggctccagagttatacgatgaagactacacagaattggtggacatatactcatttgggatgtgtgtgttagagatggtgacagtggagattccttatagtgaatgtgacaatgttgctaaaatatacaagaaggtgtcttctggagttagacctgctgccttgaacaaggtcaaagatcctgaggttaaggcctttattgagaagtgccttgctcggccaagggctaggccttctgcagctgagcttctcagagatcctttctttgatgagattgttgatgatgaagaaaatgatgactgttcttgttcataccaatagaatatttcttacagtgttgatttgatatgtgtgtgtgtgtgttttttttttaaatttgattcacctaccttttcagtatgcaatgtcaatttgggcagcctagaactgtgaacataaattgtttatatattttttccatttggctagttgtgaaattggataaggtttggttgaatatgggggttaccaggggagggcttgattggggttggtgtccttttgtttttgtacataggaaattttacagatgagttgtgcggcatacattgaatgatgatttgatttgacaatatatgttaaaatagtatattagatgttatcagcagtcaagggatgtgtgatggaataaatactatatcttgaaaaataaaaatagtactaaagatgtaatcttagaaaggaaattgtataaaaaaatataactgtcccattttagaaggacgtgattctagtaaactaaaggatatgtattaacgatttcatccaaatataaaattacattttaaaaactattctcttcatccttgaaaatcaaatcctttatgtactttttattttatcattttgtagtgtacaagatttattaatctttttatacaagtttatttaaataaaccctaaatttaccatccttaagaatgttggaatatcaaaaatggtatttcaatatttgaatgcttccttttattgccaccttcaataatggaaatgagatattggaagcaatcaaaaacaatgtcagaatgaaaagggttttatcgtttgatttgagggcaaagaaaagtgaagtcaagggtttgaacgcagtttaagcagcatgatatatgttggaggccagcttacatataataatcacaacaagcaaaatgagttgttcatgttttaaaaattggtccaacggctaagcttaatgatgaagagaagtaggtgtgaactaaagggtatttagacttgtatcgtgcaaccccactcatttttgttgtgaaattaatcaaattattgtagtgacccgttgggtgtaccacatcttttttctccttaaaccaataaggaattttgacattgacttttcttattgttttcaatattcttttatttgagggtacgaatccaagcattgtactttgcaaattcctcacgaatgccaaagaactactacataattcaacaacaataaaataatatcattgccaaaagaaaataacacttatcagattcatcttctgcaagagcaaattggagataaagacaagtacaaggtggttaaacaaccttaggggcaatttcaatggaagtttgccaatggaattatggcaggggaatatattccattttaatttcgttacgtttgatgttataacagcgattgcggtaatatcgctcatatattagtacttcatatcatgcaggtcaaggtagatagaggaaatattttttgcagaggtggaaagtcaatgaatgtttattttcaattattaattagttgttcatgtataatctaacatattcaaggcacggcacatgctaatgctacaattagtctcctatctatataaccaggtccatgacagctatttgccaaaaaataagattttttttttttgttttaatgtaaaccagtttaggcaatacaaatatataaaaaaaatacactatttcaaaacagattgcattatgtagttcattaattaaattttatgacattaatgataaaaaaaatagttgcttttaagaactaatttattgtgaatgattttcttgcaaaaattatattaaatttaaaagtgcgatcagagtattaaatttaaatttggaattaatttaattactttcacttatattgatttgatttagaaatatccataatgaaaacttataaagaagataagatttgaattgatttgtaaattaaccttaatatttggatcaccttttttttttaatcatatttggatcaccttaaaaatggataaaattattattttaacaactttatattatatcgtacttacaatagataatcataacatgtttaaattaatagattagtaaccaaattgtactttccattcgatgatatatgtagcaaaattatttatatttagaaaataaataacttgtttaatgtgttgaattttacttaaatttggctgaattctgattagtctggtctcttttctccattgttcggaggtttatcattatgcacagttaagaggaagggatatgtttccggatttgaacctatgaccaataaatcagcaagatataactttaccgttatgtcaggactcgtcctcaatcaaagataatatcagaagatttataataactcatacactatattcaatcgactaagttaaatctcccgaaaaattaacgaattttatattaaccaattgttagaagtagaaggtactgaactttttggtatgcaagcagagttccagggaagtgtacacatgagataagatatatatttcacttggcttgtgacaaataatactcacttccataatctctagttatgcaatttaacgtgctactcactaattctttcttatgcaatgactcagccgcatactcatgaccacagtcccccacaacaaatataagagttaaaaaaaagtggtttaatgtactctgtcttctattattttcctttcctttatttactgtgtctagtctcttttctcccaaacaagagttctgttttcccccctttctgcgtcatttattgcgtttacctataagacatgcaggatatgatgataattgataagggttaagataaaaaagggaaaacaaaaaataatagagtgaaaatcacctatgtatcaaggcactcataatgtctataaacactctcaattttctttacaaatcctagccggcacacctataatcgatgtcgtccaacattcacccatattattactcaaataaattaattaaaattattcattcttatgtgttaaatgaatatatatatatatatatatatatatatatatattgtcaaaataaaaaaataatatattaacgttttggtgctcacatcacatctataacagctttcagcacggttaatgtttttaatatgtttggtttagaatcatgttctccagatccatttttattaactcttatatatatatatatatatatatatatatatatataagagcattgctatttttgttaccaaagaaacctcagtacaaattgtaacgaaaagtgttaaactaatgaaaaaagtgttatatattaatagtataaaagttttattatatgtatctaattataatttgtgattgaataatattttacattgtcagtatcttgataataaactctaatctagttacgatattatttgtcagaaaacaataatgataatttgaatagataggcaaataaaaattggccttgtaacatttatatcaatttgtgcattttttagtattaaggattagttggacttttgatccctcaagtatcataattgtacaatatcaattttaatttttcagattttaaatgtgtcaattaatatcgaattcctcatgtattgcaaatatttgattttaatcctcaaagtatatttattttttctttacccccaagcgtgtgtgtatatatattaataagaatgatgttgttctattaaaaaaaactaaaattgtaccattacaatgttagaaaattcaattaaaatttaagaaacttaaattgcacaattagtcaattatgatcctagacgatgacgtgtgacaaacctttttatcaccattggatttattatattttaaataaaaggctgtgattttactagctttatctttttattttattttatcaactttcccaaattctcgtgagatcccttctctctaaccactatcgtgcaatttctgctcgctcacaataacctgaaagctgtaagaaaaaaataaccatacaatacaggtgaaagaagaagaaaaaaatgaaatcttaccttacattaaaaagaataaaagggaaatttaataaatacttaaaaaacataagatgagtaaaatataggaaataaaaagctaaagtttcacaaatgattactagaagtagtatctcaaaaaaacattacaatatactactaacaaggttaaataaggttttcaacctcaacccaacatgaaaaaacttacaaaaaaaatctcattttaataaataaaattcatgatatccttatttctaataatacttaataaaagtaataatactaataattatccagaattagagaaaaaaaagagatatattttttcaagctaataaaaaaaaatagaaaactaaccgaaatagcgtttcgaacataacggtaaaatttattttttatacttatatatatatatggggtaggtactgaaaagaaaaggtgaatattttagttggagaacagaggatcaaaactcctatctacacacgctgtaaaattttgaaatcccttgtacaaacacttccttagtttatagtaggatagatgcttcatgacaagagttatactgataccttgcaattatgttgtcaatcccgatatacataccattcatcaattttggaacaacgtgtaattttatattgcatgtagatattaacgatgtaccactaaaaacaagtattacacgtatctagcgaaaacttctaagaagagacatgtctttatccaatgcacaaataaagaagattgcaggactaacatgattctctcgcgaaacccttagctacagaggagaaagccaattggagggggtgaccacaaaaaaaaatgcagaacacaagagattttgctgtgtttctaaggaggctagtttcctttgctatccttattttctttatagtagaatgtacaagaggtgattcatcagaatctgagtctttcttcaatttcataagggcccttgatcccaaaaacgtgcttaacattacctggattgagtcaccatcccatccatgcttggtcaagttgaatggtgtaagatgcaacttaaatgctaccaatattgtacatataaggcttgataacttgaaccttagtggcacaatcgatgcagattccctatgcaggctccaaaagttaagagtggtaagcttggctaacaacaacattagaggaaccataccacactcaattttgcgttgtacaaggttgacacatttaaatgtaaccggcaaccaattgagtgggaggttgccaaatgccttaacaaaattgaaacatcttaggaacttagacatttccaataacaacttttctggtacgatccctagtaaacaacattatattcacctccttagttattatgtgactccaagtaacaagttggaaagcaatagtaccaaagagtggctaaaggaaagtgacacaaacacaatacagcaagcaacgccaggtcctttaagcgacagcacacctaataatggcaagaatccacggccagaaaccttgggggtgatacttttgggtgctggattgcttttgtcaaccatttactttattgtaaagaagtcaggaaaattaagtgcagagagagaggtagttaaagaccatcgtcgtttgtctccaataacaaaggctacaactcatgaagttcacgaggtgaagctaaaggaaggagattctgagcttgttttctttgttgaagatcgtgaaaggttcacactcgaggaccttcttcgagccaccgctgacttgaggagtgaaggcttttgcagcagcctttacaaggtgaaattggaacacaatgttcactatgcagtcaaaagattgaagaatttgcaggtatccttggaagaatttggtgaaacattaaggaagataagtaacttgaagcatcagaatattctcccccttgttggttatcgttctaccagtgaagaaaaactcatcatttacaaatatcaaagcaatggaagcctgcttaatctgttaaacggtaagttaagattaatttgtttttcatcagctgcaacactccatatcatcttctctatttgttccctaacttgtgctgcacgagtaattatgtttctgccttgatcatttgaacaatctagctgaaaccccacattagtacattaatataaggcaaatgctaataagtgattaaaaaaacaaagtgattttttttttatcaaaagtgaaacatttaatatatcatgatataaaagttatttgacacttaattataagtaggaatgactttagaatatacagaattacagatagtgtgaagagtttttacattgccatccaatcatgaattgtcatgtataataagattgttgatgacttttgtaataagagtcttatttctaattggttgatagcataaacacaccaccaatgtatcaaaactaaaagtaattgattttttttttttttatgcagattatatagcaggtagaaaagatttcccatggaaaatgcgtttgaatatagcatgtgggattgcaaggggtttggccttcatatataggaagttggatggagaggaggaggtcattcctcatggaaatctcaagccatcaaacatccttcttgatgagaacagtgagccactaataagtgagcatggcttatcaaaattcatggacccaaatagaggtttcttgttttcctctcagggatacacagctcctgaaaagagcctaacagaaaagggtgatgtgtatagctttggagtgattctcttggaactactaacaggaaaaagcacagaggtgagtagaatagaccttgctagatgggtaaggtccatggtaagggaggaatggacaggagaggtatttgacaaagaggttagggaaaatgatcatcaatgggcatttcctcttctcaatatagccctcttgtgtgtgtcacgtttccaagaaaataggccaaccactatggagattttggagaagattgaggaggtcatggatcaacatgaacaacatcacgaacgttgtgcttccaaatgctgttccattggatccaaccacgatgagtgttgttcacttcacaaaatcatacctgaaacgtgggattctccaggatcaaattattgatttatcttcatgctccctataataacatgtattcacctatttatatatcatagtgattcctgtgtgagagcttttctaatttagtcccacatgacttagaaactatgggcattatctagtagaaaaacatgtgatactttgtagtcatcggtttgttataaaggaattaatcctgtattctggaactatgcttttgaacttgattagatacatgttattttaatattttgttaattatgaattttttaactatattttgctatataaatgtagctatatatgcttcaagttgttgattatatagacaacaagcaaaagcagacaggtgttgaaataagtgtactcaaaattgaatttgtttaatcaaatgattaatgtgctgaaattaaagttgaattgtttaaataatatccaaatttgatcatttgtcaaactttacttatcttctaaaatatacttcaaattagtcacaatttatttctcttgatgaaacagagttaaagaccaaaaaaattgaacttgtttatcatgaaaggacaaggaaaagaatcatgtacattccatctgaaatttcaataacatatctgtagaatacaatgatgttacctaactcttaatatatgctaaaatgctaataactttttattttttatttatcccaaaacaaaagagtgtggcatggtggaagccctactgaagctacctggatttgtgggttttacttgaatttttacccacctgaacagatgaataatgataagcatgtcatgcgattgaaactcgtttgggttgatttttcaaaagcaatgagcgtgtgcggatgataattactgctacaaaaaagataaagcaatgaaatagttaatcgaagaataattattatgtctccttgagtcagttcaagtgaaattgtgaaacataaattctgagtacaggaattcgatctctgttatatatttccccttctaaatattttaacttcagattagcttattagaggcttttaatcaatttgctctaacaggtttatctatttggcatgtccaatccatataaatccctatttgtcttacctcgtcaatcaaaacaaaagcaaattggaaaacttaagggaaaaataatatgaaattcctagaataaaacgtattactatatattttttttttggcataaatatttgtgtgaaaagttttattattaattttcatgtataactatatcctattatatcccgattaccaaaaagtttaatttttaatatgaaatatttatgtgagaaattttatttactttttataatagtgacaatggagtttaaatctagaacgaaacctcatgtaaattatctaaacctgttactatgaagttgatccgagtaaaagttttattattattattattattatatgaacatgatgactttatgataccaaacttctgaaaaataacttgccaacaaaatatgaaatttgaaggttgtgtaaaatgtagagagtgtttagaaaagaaagctcaaggaaaataacatcttactatgaaaaagtccaaaaaaagagcgtctcaacagctgaggtctaagttgagtagcatcaaaggcttccaaatcctaaggtcaaacttgggtttccctctgctatttattggtcttcgcagtgttgattcaccgcttaaatgtgcttacgttttttcaacactttaagggttttttttttcttttttcttttttccatacacttgaatgttctagcgtgtaggaactgtgccgcctagtgggctcatactgcagtaaaagaaatccaacttggctctttacatgggactttcaatagcattattcatggtcgtgcagcttcggggattaggggcagcatctgctgtttggctcttgctcttgcttctactgtttattgtatttggtcatataggaactctattatttttaacgggcacgtttttaatctttctgatgttgtggaaaagattaaatttcgtgtgatttggatgagtcatttgtcgcacttgtattagcaactcttttgctttgattagttgcttctctttgacaagtgtaacagcttttgctgtttgattctaccatgtatgtcctgtgtattttgtaagtatcttattggttaatatactcatttacatattttcccaaaaaaaaagaaatccaactgggaatagaaaggcctttagagaagaaaattacgattatttggttttaaaaaaatgttttattttttattttcatttctactcataaagtattatactttattttttcttcttcaatatttcttatataagcttttaaaaataagaaaaagaaaaatgaggtcaatgcgttatgattacgtagtacgttatgatgggtttgttttggaaaaaacccaaggtaaggggttactccagattcagcttcaaatattgcgatctctgcctaagccttttagagtagctttcaaggtgtccataggaggaaccaactgatcataggaatgtggaaaaatatgttaccaaccagtctttccgtgttcttgttttccttcatatgtcaacttggtgtaactcaacgttgagtgttcacgtagcattgcataataataataatagttattagacatttgttgttggtttttcctttgtttataggaattacccgtcggtttgagctgcactttcagttgttaccccatcaaaactctcaatcaaattttaaataaaataaacaaaaaagttgatgctccatctactcccacaataacctaacattttaattcttttgttactctatctttaaaacgttgtaataatctgcaacatttaaagctcattttgaatccaaagcatgaaaagtagttggtgtgaacaattttagactctttttcttaaataaaattttgagtttggatcttgtggagattaaaaacgtaattgaaagaaaaaattccattaaaaatgataataataagtcaatatcataatataaaaaaaattacaagaacaaaatcttaagatatcattatttgtattaacatcatgatcatggatgggtaaggatattaaagctgaacacaaattttaaggatgaaaaatgcttactatcataaatttaaaacgtttttttttataacaatttaaaacgtttttatctctgtgtgtaatcaatacgtaaaataatttgaagtgtcacgtaacatattcttattgctatggcgtttcctatttccaatccgatgattccccaccccccccctcctcctcctccctctcctctcctcctcctcctcctcctaagtatgcatatatcattccatatccaaaacaattaataaattatatttttttcacttttacaaaaaaaaaaaagttatgcaaaatctaaaaaagacgattttgtaccaaataatatgagctaaatcacctacaaatattaattgttcctcgagagtaaaactactacttcaatatgcattttgaagtaaatattagtccaaattctttgaaacaaatatcatcatttcattcgttatttccagaacggttttgcattttgcgagctgttagatgaaaagcatctccaattgaatttcctctttggaacatgatgccaagtaatggaaagcataaattagttttcttaaatatatataatttatacagagaggatagtaataaaatatctaatcaaatttgatcctatataataaatttacattttcatttttaaagtcagatattttttgtgtatatttttctctttccttctgtaacacatgtcaaattaatgtccattcagcaaaaaaaaaaatgtcaaattaatgtttttccttttaattaattattcacttaaatggtacatgtattcttcctatttttttcttgttacctttttctttttaggttggatttgctaccttatatctatataaaatataaaatatatcaaattaataattactataacaaacaatttgttcaacaactccactgcatctatatatattcacattaatttattttatgaaaattcatattatttatttaaaagaaataagtaattaggtgatttacattttccctttatatatagttgaatttatttaattttaaaaataccatgatctgttgtcatttgctggctcctccaaatattcttgcacgatttgcagtgtgtgtctgtctgtctctctctctttctctcttaaaatatatctatttatatataaatagtgaactgtgttttgcccatctttgcttcaaattccatttcttttgatttaattaagagtacctagttgaagcaagcaacaagataagaaagcaaaacaggagagagagaggatgacaccacatcctctgttttcattctcattcttagttttccctgccattcaaattttcacatgacctctcattatttattttttattattagtttcttttgtttccatcaccaaccattcatctttggatggtgaattccccatctgggttcctctctttttcctttgatctcttcgccttctctcaatttcttcttctctgatcccagaaaagaaacaaaaaaacaaactaaaaaaaacatttaagaacatttttttttataaaaaaaacatagctgcttggttttctctctttgctggattagatattttggttcagttttttttattgatgctccaaagatccgattctcttagatcgaatttggcataacccacttcgtatctgattgaagcaccaactgggttctgtctgagattcaacataaggtgacccttcttcacagatttatctaatctgcatttctgatcgctttgctttgtttttgctcatgaaaaattgaatctttctggtgatttagctcaattatgcattattcaatcagctatgcatttagattggttctgggactggaactttgcccatcactgaataatatagaatctagattttgtgtattggaatttctaattttttttatgttatattgttttttggtttggcatgagaattttgattcaataagaatggttggattggatttgtttgatgaaatgagtgattgatggttaactgggcatggttggtgacagaacagatggagtcggatcttggcaagctcttcattgggggaatttcctgggacaccgatgacgaacgtctgaaagaatattttgggaaatatggagaggtgatagaggctgtgatcatgagagatcggacaacaggccgtgctcgcggtttcggttttgttgtctttgctgatccttcagctgcagagagagtcattatggataagcacataattgatggccgcacagtgagtttttcatcatagatttgttaagcattatttcaatatacatgttatttggatgggcagtgatgggacctagctaaatttatgtttctgatagagatcattgtgtccctacttttatattttcttataggacaggaagctgaaaatgacttgcagatttgatccgtgtgtgttgtgctgtcaatttgcaggttgaagctaagaaagctgttcctagggatgatcagcaaactataaacagacagtctggtagcatccatggatctccaagtcctggacgcaccaaaaagatttttgttggaggtttaccatcaacaatcacagagagtgattttaagaagtactttgatcagtttggtacaattactgatgttgttgtaatgtatgatcacaatacccagaggccaagaggttttggcttcatcacttatgattcagaagaagctgtggacagagttctttataagacatttcatgaactcaatgggaagatggttgaggtcaagagggcagttcctaaagagctttcccctggacctacccgaagcccattgataggatataactatggtttgaataggaccagtagcttcctaaatagttatgctcagggtttcaatatgaatccaattggaggttatggagtcaggatggatggaaggtttagtccacttactagtgccagaagtgggtttaccccatttggctccagtggttatggaatgggagtgaatttggatttaggattgaacccaagctatggagggacttccagttatggtggcggtcttggatacgctcggatgagtcctttcaacaatggcaactctaacagatataccactcctattggcaatagcgggggcaatgggagaagcgattctcttatgaactcagcttcccggagtgtttggggaaatgggggcctgaacaatgctgccaatagtccagtcagccctggcgcttacttgggatctggaagtggggcttttggtgtttcaattggaaatggtggcaccaattggggtccatcagttccaacccagggtggaggggctgccactgggtatagtacttggggtaactcttatgaaggtggagataacagcatcagtttaggaggtggagggtatggaaggaacagcagcccaagtgtgcctcaatcctcaacatttactgcaccaactggtgattatgaaggatcctatggggatttgtaccgcaatggttcagtttatggtgactcaacttggcggtctgctgcttctgagatagatgcttctggttcgtttggttatggtggacttggtggtatagcttcagatgatccagtaaagagttctgagggttttattggaaactacaatgtaataagtagacaaactaatagaggtaagatctttggctacatgcttgtctcatgtagaaaattagatcatagtttatacattgtctgttgtttattccattttttcataaaaccaattgtgtgttttggactttctatgtttcagaataggaatattactgaagaaagttgaaaactaagtctgtttattttttaatgtgctattacatttgtctttaagcttatgatcatcatgttagaattgtgaatatagataaacataacatggaagcattattcatgtcttttgattatcccaaacaccctaggttcctgactttattgacatgtttcctttattcctttattcttgatgttgtcattgtaaattcttactacagtctaaaagtatattagggcctctgtggtttgtttgagaaaacattttatgttctcatttcttattttcgcatgtaattactaaaatatcacttaatttttactttatgttttcaaagatttatataggaaatagtgaaaaccactgagaagttatattttctataaaataaatgttttcaccatttcttgtgcaaatctttgaaaacaggaataaagtaaaaaacaaagtggcatttttttaattattagtgaaaacaaaaagaaaaaaaaaaaagaagaaatattctcaaaccaagtatgcccttagcttgctgtaataatgcctgagtttcttgattactttcatttaaagatattcaaatttgatgtttcatgtgaagttatactaacttgcaagatgctagagatgtaggcatagattactcactcttgttaattgagtatgatgattttctcaataattaggatttgagagcttcaaactgtaaaacagaatatagacatagattacacccctttgattcgttagtgaaaaatgaggtttgattatactttcttgtattatattgttgtgaaagggttggcatttgagtatttccattacgtttttttacctgttctggttcaacttcattgaatactcattttcttttgttgcatgtctacttgtttcaggaattgctgcttaggagatatgttaattggatatgttatggtaacagtagatcaagggaaactgattaaaggtgaaatcatacggaagctaaatcagtcacaagtgtttttgtgtaaggtttgggatttttgttgtctttatttttcaaggctaggttcctttcttggaatttgattgaggtgtaacatcagattgcgggatatactcaggaagattggttccagtagtttaattgtgcattgctggagggatgcaccatcatcgttaatatgcttaatgatagtttattaatttttgatttttttttttttttttgccactgtaatgcttggcaaagctgtttgttcttgtcaccatctttttcatgggacatgtttctgatcaaattgtaagtgaagttctgtttgatttatcaggtttgatacattagaggggtacccatcttggatcccccatcaaataattagttactggacagatattattttttgttagacttttgttatacaactttatactttggtttattgttacattcaaaatttggttcctgctgatattacgactctattcataatagttgctttctctcctgtttggttgttgtaactttgtggtgaaaatatcgagcatgctatagcatctttttatggaccaaaattgattggttaaaataagggagcatggttcatttttttttggtagcttatgtttgtcaatagtaaatactaaatagtaacttttttagttttttggttgtttcttacaattccaatttggatcttaagatagaatttgtgtgtggtcatgctaactcttatccttatatggatcatgatttgtcttgtatcactttcagttttcccctgaaaaccccccattacaatgtggtcctctctctctctctctccccacagaggacacacaaaattgtatataactatatatatatccatagtcttagctattaaacagcttatattaacttggatgtgcacaattattagtacaatacttgggtagaatatcattattctaagccatgcaagcctgtgttggagattttagacgattgtcacatgcaaatccatataaatgcacatgcctcaattatgttgaaggttgtggttgtagacatatggtggaatctttattaatttgaagacaatagcgtgtggcaaactggcaatgacaaaatcatggatgataacaatgtttcgtttcagaactccttggaagtttgaatgggaaaacaatgcatgaatgaaattgaggctctatagataaggatgttggggatattgaaatatatgataccataactattttcaaaagcaatatgccttaggctaacatcgggacatattcttgtgtatttcttttttcattttataacatttttggagcttttatatctaattaaattaatacttttaattaatttcaatggatatttgcaatttcctatatatcgtatattaatgaaatttaaatcagtgcatttagatcggtttgtctctttcaacttatttattgaattagtttaatttatatgcactaaaatgtgtgtttgtgtttggcttaggaaataaaagtgaaagaaaagaaaagagtgaaaattgagatgtctttgcaaatttttcttctcttgtttgattttttagaaaaaaatgaaatacaaaatatgaatataaaaatgacgtaaatatatctactaaaaaattatacatacaataacagtaattgaatctttatttataattacataaaactatccaaaaattagacacgtgtcaccattttgtgccaatttttacattttttttttctatttatctctttgcaaattgcaatttttttattaattagttttccattgaccttgcaaagcacaggtccagtgttgtagttatttaagcaagaattccttcccctttctcttcaaattcggaggcattattgaagtgtgtaggtactaggttctttccttctattttgaagatgaaaaagaatatagaaaaaaaaggggtatttaagtctgtttaaataaactttcctttccctttcttttcacatttggaagaattattagtgcgtgtgagctcatgctttttattccttctttctctttttttaagtgctccaaacaaagaaaataataaaaaaattggtgtttctctttcatccttcccatttttttcctaaactaactgtaggaggactttggtaggggaatattttttgattttatgagaattataggttgaaaaacttagttttccatgtttgatatattttttaaaaataatatttctttaaaaggatatttgtaaatcaattttccatataaaaaaaatcaatgaaaaaggtgaaaatcttaattttcacaagtaatttgtcttttaatacattaaaaatatcatcttactctttatcaaattatttaatttagtgaaaatattgtataactctttgatttttaaaaaacttatttaagattccaataatcaatcaaacaaattttattcatttccaaaaaatataattcctaagattcataatcttcagaaatcataattcttgcacataaaaaaattgctcttgtattaaacgtggtttaagaattgaaaaatgtcaaccaaaattttggtataattgctataaccttattttgaatcagctaacaatgtaaaaatggacatcaatcaaataacaatgtaaaaattatttacactgtctgttcatcaattaattattcttatcgaatcagcttggttatagagttgccataagcccataaccttatagtgtccgcagtcaaaacaagcaacatttttatactctacattgggttgttcacggagaggcattctagtaagcttttctgtttgggtcggtctttgccagcaaatgtttttccttatgggattggggtcatgccgtgtgtgtttgtttaagttttgtgatcataccaatgctcacatcacggtccatataggcttaggctggttgaatctttgtggtaggacctttagaattgcaaacaatcaaatatatggtatcataattgatgccacaaatgagatgttacaacaagtttacaacttctgctaaaagttcatccaccttttacttgatatacgactctctgtaaagttgtgacaggagtaacaatttgtcccacagcttacaaatagaattgttttattgacgaacgagtcatatttaacgcgatgaaggatattaaaatgttagaaaatttttgtaaacatataaattataataggagtagtgataaaaaactacatattgttaaccataacatatcactcggcttaaagtcaaacactaatttttcaaagtaataatatttatttaagagattcatttcttccatagatatattttcatacacattttatgccgattttcataatttgaaaatagaaattgatgtttacaaatcattatttgatctgtatgaaaacattttttaaaacattaaattattctttattaaaatattctcatttcattaattaataatctcttattttatgtattaaagatgataagagatgagggtaaagtttaaataactataattttttcttttgctaaatcaaatatttttttaaaataaaaaatattttaaagccaaagaaaaattgcataaaaatataaaattattttttaatttttttattaaacagttataaaagatatattttaaaatttattaatttaaataaaaaaatggaagagtagaagatagatgtgatcagtaaattatattctaaaataatcatggtttcctcatacttttacttactttttttaggtctcctgttttggcattacttttgtcctatgttttaccactttcttttctatggagggctttgttttacatattcattgcgtattttcgagaataccaagttgggaaaacgactttttttttttggaaaaacatgagttctgttacacttgccaaaagaagcaaataaataatagttagagttagccaactaatttctatacaaacacaaatttgctaatacaagtgtaacaaatgaaccatcttaagcacatgaaatttaattttctcaataacatcaacaatatttaaagtttgaccataaaaaagaatacagtttcttgtcatccaaatacaacaaactgggaatgccagagccaagcacctcatcttcccaaagtgatcggaagtagcatgctgatggattaagctattcaaagtgcctgcaatgaaatatttcttctaggaaatccgatccaatcccgaactgctgaccaaatgcacaaagaaaatctgcactgaaaaaataaacgatcatgcgtttccacatcagaattacaaaatgaacataagctttctttttcaaggaacggtgccttgtccaaattacaattttagcttataactataactagttggctagctttgcattaccctacaatgcacgggttggcttggttactaccaaattatatttacaagaaattaagatactctgcaactacttttcaaactacaagcatcttgcgatcacaccatagtttttaagataccccaaagggatatgcacactgccagattgaaataatatattttttcgatcatacccttcttctcttgcacagttgcactcatgccgttcacctccaccatgatcactgtttcccttttccaatctcaacaacttccaatctccgctcacatcttcgtcgatgctctcgacaccttcaaacctcaactttctctctctctctctctctctctctctccctctcccgcactacaactcgcgagatcaattcgccgtggttgtgcggtggtggttggttcaggattcaactagaatgggtttttgttatgtgtggtttaatttgggttttggggagaattgtttcctcatcgttggggttgtaggcaagtttaaaaaaaaaaaaaaaaaagatgcgttttttgggatgaatttgtaggtggaggagttgcggctgccgctgaggtgggggattcgtggtggttcacggtgttgtgacggtgggttttacgacggggtaggtcggatttcagatctaaggaggacattaatcgttttcattttgttctctgttgacaccgtcgatgcggagcagtggcgactacggggtggtgtcagagagggagggatggttggatactatgaagggagagggacatatcgagaaagaaaaataaaaaaataatttctatgctgacctgcataattttagggttttgacagtcttaatttttaaccaatattattacatgttattttttcattagtttttcttttcttttcaaattagtccttattttttttttaattttcaattttttaaattaaaaatatgattaaaaataattttagtagtatgaattctaattttttttagtttcctttcaacacttttttttataaaaaatcttttggggtttaaggttttataaagagcattgaaagtaatttaaaaaatagggtttaattaaaaagatgacataattttattgattaaaaaattcacagtatcaaaatccctcaaattattaagaaaataatacttttaattttatccggtgtagggatttccaccgtagttcatcactattttaaccactgatgttaaatttaaaaattcatatccagcggatgatgtttgtttcgcaccgtgagtgtctttccaaaacttttctgtcacttgtcagcaccgtgtgtttttaaatgtgttgctagtgaaagtcattggatttaaactgaatcagatgtagttcacttgtgaactcgaggatccatatcgtatataacaatttaagatagttgtatataaagaaaatagtttaattttcattgagtacaatacctcaaattttaggagaatttcattttcgttaacaaaacaccattattccaaaaatccaaaattgagtacaaaacctcaaattttaggagtatttcattttcgtaacaaaacagcatcattccaaatatccaaagttgtttaatttggataaaagaatgtaggcttaaggcccaaatcacgaaaaagaaaaagaaaagcatatccatgatgctgtacggtactcttgttcgtgtgaaatagaagaaatcaaaatcatagatgatttggtacctccatcaactttagtattcgccatgtgaacgtggggaccatgttagtaccactcgtgattatccacagcatgaaacttttgccagatgaaaatcgctttcacaaaatattgacatccaaaacaaaaagaaacacaagaaaataagatcaagacagaaaaaagttcatgtagcagttaagataggaccaagcctgtgagaatacaaagttaagattccctgttacctataacagatcaacaagtacagaagcgagaatcccactggacagtgcattatttcatttcactactgacatcagttttcattctaaatcctatgtcacctgaaagtattcccttgatccaaaggtaaccaaaagttcagaagaaagccctgctgccataaaacacacgggagttagtgctctttggtgtctgtatcttctgttcagagctagagtttcctgaactagttggtccactttcaaagtccataggaagcttcattttcgccagtgactcggtgaattgctgcatgcttttcatgtacatgtctacaaaatcctgctgcaccacattaggctccggctcgatgttaacagtcacaacaggcttagtgaatgactcattcagcaccccatttgaggagtcactcccaccatctttgacatccccatttttctcttcggtggctgaaatttgttcctgactgggagacttggaagcagcaacatcagatgagtctgagcttgcagccactgaaggagatgaaaccccatttgttaacacactgctgcgtggagaatcagccttaggaggttggacagattcaacactgcatgctgagaagctctccacaatctgaacacctgcttcagaactaagattttcagtatcagtagtggtcaagctatcagaacactggctctcctcacatggaatgccaaagtattccgaaaccatccagtggtcttcatttacaatttttggatctgggaattcaattttgtccaaatctctggccagtgactcacatgattctgagtccttctcggtgccatttgcggccaactcagtaggcattgcagaaatagccataacatcaggtgaagcaccgatataagcaagagacaatttaacaaaaccagctggggaatgaaataaatcagttgaagaaagagagaactctttctcaagttttccatccttcaccagtacttcagacaaaggcaccaaagcaaaaccaagcaactgatcttcaagataattcttcaccctgctcagcatccaaatttcacatttgacagcagaatcaacagtcctaacgcttagacgaagattctcattgaagacagggttccttcctcctccattgacagtcttggtagagacagtattctcaggattactagtcaagcaaatcttagcataaacatcttgcttgtggtatatgcagatgttatgaatgtccctggcctgatgaatgtaaacatcaacaacaccgatggattcctccggattaacctcggcagcttcccttccattgacttcaatgtccttagacaaaggacccgagctttgtgtgaaaacatcagacctatacttctcagcttcacccaagacagagctcttgaatggtgacacaacagattgtggggattccatgatatcacagtgattgggaacctgacaaagcaaaaaaaccttcaacaaattcaagtcactctatgttaagctaagcttcaaaccaacatcacaaatgattttttgaacttaaacccaaacttcaaacaggaacaaggaacaggaagaactcaaaattcactattccaagaccaaaactgctaaaactcagcttgaaaatacttccttacaatttgcagcccaggaaggattaagcacatccaaaacagatagaaagtttctagtatgtgaattgtgaagtacaaaaaaatagaaaaaggaagaaaaaggaaaggcaacactcaatccccaaatgtgaaagagaagtgggaagcttcaatctgaatttctcctaagggctgtcacgtgagttgtcaactaacaggaaggaaggcaattcagaaacaacaactccagttcataccttaactttatagctaagagcagagaaacacggaattgaggatcaaggtccacaaaacccaagtagagtgaaacgaattcccaggaaccagaacctcagcttcaaaattgaaacttttcactttctagagaaatactaagatgcccagaaccggctaaaacttaaaagctatcaataagaataaagggtattgccagatttgaggagattctaataaagctactagcttttttttctgctgctctatgcagaaaaactaccagcggaatccaagggagggaaacagttaaagcaaaaatagaaacatacaagaattcagagagaaacaggaaacaaaaaaagaagagagactttgattaaaaacacagagatgattaagttgttgtggtttaacatacctgccttaggcccttagcctccaaagtcaaagcggaatgtgttatgtttgtggctctaatccagaatgaaggacacacaccgtgttggtgatgagaagagaaggaacaaaagcaaggtggcttgtttaaaaaagggaagggataatgtgaaaggaaaggaggaaatagtgtgaacagtgaagaaaataaaaatctagaggtgctgtagtgttgtgtgttggtctatgattttgttgtgtgtatttggagtatgtatgttgagagtatatatgagcaattaataaggtgctgtgcatacacagagggcactcatttattgcaattgttgtgtgtggggatagagagagagagagaggataaggtatggaaatggaaggggatgcagcagccccgcgcgaatggctgagacagaccaataagaagggagttgtgtgcattttgcagttggaggtggggtatgctgcttatgacttttctttgtactttttctgctccacacttctctttctgcccccacctacgactttgagtgagtgcatttctgtccttctagtgttttttattgtttttttttaaacaaattaaagtttaatggtgatgttggtaatgtataaataatataaaattattttatattattatttaattcttaaaaaattgttatcaaattataaattatcatttgtataatttttaagataatttaataaaatttaataaatttatcataaattataaattgtaatttaatgataattttacattgttacttattagtgtataatcttttttttcttaaaattatacatatatattttataaacagataattttgtttgaactatgtagtatttaagataattcttttttttttttacaaaactaatgaatataacttagttgataatatacattaagtttatgagagaaaatatgagaaagaacaaagaattttaaatatgattataagtttggattcgaggattaattctataatttgtccaaaaggtcaagcttgtagttgtgggatatcttagagtctcaagaaacaaaaactctaattagagagtacttaaaatatttatgtatcttgatgtatatgtccatgatatttcttttttgttgctttcacatgattatgaagaataatttataagataatagtttaattttcatcctttacaaaaaaaattcatgttataatttcggttatatccagtccttataaaaatgagttagtattaattttagctattataaaaaaattatttaatttgtgtccctttaaaatatgaaattagtgtttttcatctttataaaaacagtaaattttgattttggtttttgtttccttcatatatccttcctaaatgtgaaatcattgtttttttcttcataaatatcatttttagaggtaattttgtttgagacactaacaaacaataaaaaaaataatctctttaagtataaattcgaaccttgatttgtcagtttgtgaggatgagtctcttccgctgcactcaatcctcgttggtaagaaactattgttttaagttcttaatgtttattttaaaaaataacattatttgaagaattaaaaataatttagaaatgttacatgctgacatagtatcacagactagtaggtgtcacttggatattcacttaacctttttattttaaaataaataagtaaataatattattctaggtatctaaaaataattttagaagtgtcacatgttgacaaggtataccacacagtaggactcacttgaaagagttactttttatgaaacatatgagtagttgagaagtgaatcttactgtatagttgacaagtagttgaaagtttcacatgttctcgatcggagcactcaggacctgagtttgccagggagatttcctactcttcatctcagtaagatttgaatttgatggctatatagatgaagacccttataatagaatttaccttgatgaacatgaacaatcaatcagtctcattatattgttgctcagccagtaggttcatgttattctgaaataccttaattacgtatactcgagtcttgggtttatagagttacaactacatatcaagaaataatcaattaaccctctttcttttcatgtataatcccataaagcaatttaacattgttggtgtttctctttctgtgtcatttttttatgtgaagaaaaatatgaagtcaaatttgatcatcaaaaatcctgtgcaggaatcctgtgcaggaaatgcattgatgttatgtgagtctagaacatgagagatttcctcgcatgataccatcggtcgcccacttatgagaagagcttttgcacttttgttctagaaatttgccctttttcttcattcgtgggtcccatggcatatgcttccccgacgtattttgcaactcttgcaccaaagttttacgtaaaaatcaaagattaatcatggtggggtcttctgctttgttcatcagctcaaaatgacttcttagaggtatcaacttaaaagaaaagaaaaatgacttggaggtagacaacaggggcgtcactagttcactattcaacaaccctcaattgtgtctttggaagagaagttaaatggcgtgaatacgtttttgtaaaacaatttcagagaaattatgttttgtcagtttgttacttatttcgtatttacttgttgaactttctttctcctacaataatttatcttgagcactatctatgaatatataaagcattcttaatagcatatatatatagcaactgaaaccatgatgtgttgataaggaatctgggtgttacgggtctcaaagtcccacattattgagtaatatggaatgttgggtgaagtatttaactgttagttctgttttttttttatatcaataaatatgttctttttatataaattaaggtatattaaagttggttatgttctctatggtgtggttgccaaaatgtcattaatttgatttttctatttataataaaataataatatttgaacatctcattattttgaccacactatctttatctcttattcttctctttttttccatcatactatcacttgtcctaacttgtaatggatataatattatttatcatacttatataagtgtaataaattatattatcttcatttttatttaaaagagagagaaaaaaccatgactccaaacatatattttatcaactaatttttaaaagaggatttcccaaatagtcagatcatcctctcttaaaagttagatgcttgtgatgttgatcttcttctaaagttgggtaatgtaatatagtataattttattggtgtaagaaattaccaattttttgtcaaactatcatagttaattatatctttcggaggactatatcgtctattattgtagaatatctcttgaaatttatcaaatatttcatccattataaatttttcagttctaaaataagatgtgacccaccactattaactactcgtgcccttcaccgattgaatattttcccttaatttcctaaatgtgacgcgtgtcgtgaaagaatcccaacccaagtcccctatcattattattattatttctatatattgttttttattaatagaaattaaagatattaccaaaatttacaacaactcatacatatttatttaactaagtgagtgagatccgtgacaatctgcatgctctttcttccccttttactttctcttttggatcggtaagaaaggatgtgcattggagtgctttcatgtgcctttctacttttgctcatcaaatacccttttttcatccttcacatatatagtcggtatatggatgccgtaatttgcgtacaaagctttcagatattagacaccgtaatgaaaattattgaccaataaagctagtataaatactaaattaatataatagattttaatatcttctttgaattttttggatttgaaggacatgtgggtaccatgtgagacttttgattgttgcaattcgctgttgcattgcatataagaacaaatggcatagtcaattattaacagtgagttgtaccatttcaagaaaaatgatataagcttctggaaagctaattacgtaattattaaactacgattactattgactcgtgatagaattgaaatgtatgtatggaggacgagcctctgatttccttcttttcttttttctttttcggtattttgagatgacaaaagatttgtatcaatgaattctaattcaattaattgaacatgacatataaattattataaaacttttgatatttatttttgattctcacatataaaaataaaaaatttgaggtgatgaaaaatttgaaggagattatcccattcaggatatatttggataaatattagaaactagttttatggattctaatgcataaaattaagaagaaaaaatattactgttttttgagtaaaaaaacttttttctcttaactaaaatttaaaaatgcacttaatggcagaagatatgctattaatttcggcgctaaccacatgattcttatcataaggaaattgttgacagtggaaactaaactcgagctttttaatttcaataattccaaactaatcatgttggcttgtgagttgaaaaaatagttatgccttgtacatttagttacataattttgcgtaattgcccaggtggattgatgctattgtgccaaataaaaggtaaaccctgaaaaagtgttggcaaatctcgacactgttatcgaaaaattgaaatcatatgtgttcatttcccattatcgttttcaatcaaactactcccatatcttttatatggataaaagataaatggatatccaaaactattagacacctaagtgtgagagaaaaatataaaaaaaaatgattccgtgattaaatatataacagtaggaaaataatactttgagaactaatatgatagtagacacatagtgagagtgataaaaaatgagaaaatataaatattataaataatataatatgataagaaaagagacagagaaaaataataaatattaaataaatgttttaaaaagaaaaatatcattgttcataatgataaaactttcagttatgtgagctagctcataatcttagtaaaaaaaaattactagttttaatttcaagttggactaactttttcctcccagcccaaaacaccacagaaaaaaacgtttaatttaaagtttttgtctaaacttatctatggttttcctctattaaagtctaagtagagttgtgtgtgtgaaaatagagggagcacaagagtaatgcatgctgttgttataattaagtttaaagttgagtgtgtggataaagctagaaagcttaaggggctaagctggctttacatgcttgaatatcatgctggtctcaatgtggcaactggagcaatagtcatcacaaaatcattcacctaaagttaagtgcgtcaagagggatcacatgtacagtctgaattgtaagctcatgttatctgcaaatgccttaattatgtgagtgtggaagagaccaaaattaattaaatataatactcgtgtgttgctcaaatttatgttaatataaagattataatttaaaatattaaatatgtatttttttagtataggatactagattgtggacaaagtttgtagtataacattatatttttattaaatttaaaatattaacaaatactatacattaaattgataattatattacttaattgatattttaatttattataataaagatttttaaaagttattacaattcagaatttaaaatacatatttaattagaataaatattgattatatattcctaccaatttttatggataatttttctttggaatgtgaataaaactgaaaaatagaagagagaaaaaaatcacatgtagaataaatataatgacaattttttatttgattgaattaattttaaattattaaagtgatagttaatgtaatttattataataaatttggattgtaaaaagatatataataaatttagaaattaaatatattcaatacatcaatattatcaatcaaacactaatttattaacatcaatatattgaataattaatttattagcataaatatgttatattaatgttagttaattacatttaattattaattatatttattagaattaaaaataaaataattttattgaatattttttaagaaaataaatataagtttgtcacattatgacatacagcaaaatcttctttttatggtagatttaatattgacctatttagatacttacaccctttacatgaataggttagagtaataattttcctgacatatctggccctttctcatctcgtcctaataaatattaatattacggaattcttctttcaattgcagccaaattgtataattgagatgttttacccttataatatccagagagaaaaaagaagaagaaaaacataggaatataaaaatcatagtcacaacaaaagctcaatttaaattaaatgttttttttttctttgtttgaagccattatttgtctttaggaaagaagaaaggataatttggtcatttcattggctattatccttcttccaacggtcatctaaacctcctcaattcaaaaacttgcttctcttctctgtcttcactctatcgacgtttgaatccaaaactctcattctttctgtgtttatcactctctctctctctctctctctctctctctctctctctctctctctctgtgtatagcttcattgctaaattgtttgcttgctcagcgaaaccataaccatgagacaaagcagtaacttagaaactgcagagactcgtttctctggcaccatttcatcctcatccctcaaaaaatttcttcccagatcactctcttccaaacacaaaaccatttcaaaccctaaaatcccaaattcagatgcagagaacactcccccaccgatcccaacatccagatcaaccatgaacaatcgttgccttccacaaccaaacaatcacagtccaaaacctcaatttctcagaacaacctcaaaaaatcgaaattccctcttgaatccgacccatcagtcaaggtaatcgccaatttttctctctttttgggcttatttttttgaacattgaagttgttatctgtgagtctgaagatgggtatgacgtatgtgaaaaaatttctgctgcttatttgcttatactatggttctgaaacaggttgtagtacggatcagacctacgaataacaatggaatagagggagatcgaactgttaagaaggtttcttctgacacattgtgtgttggggataggcaatttacctttgattcagtttttgattcgaacaccaatcaggtaaataacttcacttcattgtgctatttgtgatttatgttctttatctttcaataattttccatgataggattaaggtaatttacttactatttatatgacttgcttttataaatgaaacaactagtatttttttaactttaaataattttctctgataggattatgatacttactatttatatgacttgctcacttgctttggtgaatgaagcaactaatagttcattttatttgcttccatgctgttaagagaagataagtgtgatttatataagctgttgtttgttcaggaagatatttttcagtcagttggtgtccctttggttaagaatgctttagctggttacaacacttcaattctgtcatatggccaggtacttcttgatgtttgctatattattttaaccttttagtgagagaaaaaaatggcattcttgttcgacaattaattgttggggattttttttatttttcttttaattctttgctagtctggaagtggaaaaacttatacaatgtggggtcccccaagtgccatgtttgaggagccctcgcccaaaagtcacaagggaattgttcctcggatcttccaaatgttgttttctgagctggagagagtacgttttacttcctgctttaaccactaaatctattttctattatgtttttgattattttttatttttatttttcaattactatattaggagcagcatgtgtctgacgggaaacaattcaactaccaatgtcgatgttctttccttgaggtaattctttataaaacttcccattttggcttccttgtttgtatgatgatgatcttgtttctttttcatttgttgtttgaaacagatatacaacgaacaaattggggatttacttgatccaacccagcggaaccttgaggcacgcatatgccatccttttgtgctacaatttatcataaaagactaatacactagttttcgattgctgcatgcttattatggctggtctaaattattgcagatgaaagatgattccaaaaatgcattgtatatagagaatctgaccgaggaatatgtcactagctatgatgatgtaacacaaattctgattaaggtagggactacggaagcatcaaaggaaatataatatattgttgaatattatatgtctacatactatttatactttatcagcttagctaatttggtctttatatgctgcagggcctttcaagcagaaaagttggaacaacaagcttaaattctaagagctctagatcacatataattttcacttttgtgattgaatcttggtgtaaggtattgcccactataattgtatttaaagtgactagctatggaagactaacatcttttttttcttttttcttttttttttcttatttaagattgacacagatttatattgttaattttctcttagttaatcgctacttctggttttttttgactggtgctgcagggaatatcatcaaatggtttcagtagttcaaaatctagcagaattagcctcattgatcttgctggacaggacagaaacaaagttgaggatgcaggcaagcaatgtctaagggaagacaagaatgtaaagaagtccttatctcagcttgggtaagatgccatgtcatgactagatacaaatgtctaaagttggtagtttttcagttatccaaatatttattaaaattgtcctggcaacacatacgtggcttctcttgatttccattcctgcctcatgccatttactattttttatttgttatttgtgattttaaccgtttattgcatttttttgtctcttccgagcaaaatgcacaggaccgcatctagtgttggttgaaagcaatatcttggtcttatttatttatttaatgggtgaagttatcccgtccttattttacttctttgtaaccactattttatttcactgctgtaggcacttggtagaagccctgactaaagaaactcactcagaaaaagcagaagaaatttcaaacaggaattcctgtttaactcgtttactacaagaatcactcggtggaaatgccaaactctcattaatctgttccatctcccctgataacaagtatttacctggaccgaggagcattacctattcatgtgtatgccagacatcttatattttgtttctagtggtaaagattgtatttgttgattgtaggaataatggtgaaacgctgcgcactctcaggtttggacagcgagtaagaaccattagaaatgaacctgttatcaatgaaataaaggaggaggatgttaatgatttaagtgatcaaatccggaaactgaaggtattatttatcttcaggacttcactgacatagtttttaatgggttgatacagatctgacatcacagaattatgtgtttgctttggcgcaggaagaacttattagagcaaaggctgaagttcatagctcagatgggagtaaaaatggaaacctccaagtacgcaatgtacgggacagccttaatcagttgcgagtcagcttaaaccgctctctactcctaccctgcattgataatgacactgatgaagaggtaaatgtggacgaggaagacataaggaaattacgccagcagattgatgaattgtatcattcgtgtgaagagaaccctaaaaacatatctgtcagtgaagattgtgtccagtattattctgttgcggaaaattgtgacacagatatgaccagtggtgatgaaattgaaaaagaggaagtatgttatggagaagcaatgagtaagctatgtcccgaggaaactgagggatcaactaccaccttggatgcatcagcagatgactttgcatgcacagctaatgcctcaaggacaattaaatctacattcagagatagcatttcagttagctcatgtagtcggtctccaatacttggagaaccacagttgtctgagtctccaaaaatcaagaatgtccagaggaaaagtgtggcttattcaccaagttgtcttggaagttggaacaatgtggcagaggagaatatgagttccagtaatgatatattaaggcaatcatttaaagagggtgagcagatgcgatcgtcactacgttccagcaaggtttttcaaggtcctaccgactccttggcagcaagcctacagaggggattgcagataattgattatcaccagcgaaactcagcattaaacaaatcttcaacttccttctcttttgagtgcttaaccttgacaccttgtccagaagacaaggatgattcttgtgatcaaataatgcaacagaagaaatattctgtcgatgaaagaactgctagcttgctttgcgaatcttgccttaaaagaatatacgatcaggattctactgaggttcaagatagcataaagtcaagagttgaaacagctgaagcagagaatccggatggactgacagataaggttccaaaagtatgtcttatagacgatttccagaaagttctgtgattaattttcttgtaaaactgatttatctttgttttttatgcttaaaggatttacagagtataatggataaagcaatctcgagagaaaaggaactagagaaagtttgcaagaagcaagctgctagaattgaagaactaaatcaattggtataaggagtcatgccctcgtgaattatctgtggtgtgaattttacattactgacaatttagtttggtttgtccaggtggagaaattgaaaggagaaatggaagtaaaatcttccatcattgtgtatgatccagaaagcaataaactgactagggatgaagaagagtataactcattgaaagatgaagacaaggtcaactgttggttttgtaatttaacaatataaagtcctatccattggaatgtttggaactcgcccttttaacgtaccttttatgttgtttgcagcttccaaggggaacttccttagacaggcatttaccaggtattatagaggaaaattgtgaaattaaagaagtccaggaagacgtaaatcaaagagacagctctttcgatgcagctgagaaggaagaacttcttaaggagattcagaatctaagaagcaggatgcaattatgtagtgatgcaccagttaaaaagtccaccgacaaactaagatcatccttatcattaatgtcaagatccattcaactccgaaaaagtggtgtatttgctcttgataatggtggagatgagctagagaaagagagggagagatggacagaaatggaaagtgagtggatttgtcttacggatgaactaagagttgatcttgagtccattcgtcagagggcagagagggtagagatggaactgagtttagagaagaagtgcactgaagagttagacgatgcactaaaaagagcggttctcggacatggtagaatggtggaacactatgccgacctccaagaaaaatataatgatttggctgcaaagcacaatgctataatggaaggcatagcagaggtgaagaaagcagcggcaaaggctggaaaaaggggacatgctcgctttgccaaatctcttgctgctgagctttctgcattgagggtggagagagaaagggaagcaaaattcttgaaaaaggagaacatgaatctcaagattcaacttagagaaactgcagaagctgttcatgctgctggagaactacttgtcagactaagagaagctgagcatgcagcgtctgttgcagaggtaaaaatcccatcaattttttcaaatgcatttgataaatgaactaacttggtgggggtgcattactttatgcttaacgcaaccctccctaaaatcaatagatattagataggacttgtggaaaacgattttgtgatgatccatttcggacaattctaattttctcttgattttcatatttcttatacaggagaatttcagaaaagtgcaacaagatgatgaaaagctaaaaaagcaaatggataagctgaaaagaaaacacaagatggagattgttaccatgaaacagtaccttgcagagagcaaattaccagagtctgcactgcagccactatatagagaggattctgatgatgttcacaaggatgcaacttcccatgatgatcaggcatggagagtagagtttggagcaatctatcaacagcattattaattcgacattagttggattgattaacaattgatgagtttaacaatcaaacttccaaaagtttgtctagcatcagaagatccttcttggatcaatacaccccatttatattctctgtgttgttttaaaattcattctattttttaagctgtgtgtgttgttttaaaattcattctattttttaagctgtgggagcacttggtttttggagttcgaattcttttctgtttgtactgacagtaggtaaaagtaataacatcgaattatttgttctttaccgcttgagttttgctggcaaatacagaagctacagatttttttatgaattatttgaggaaatattgtttagaacggatagtcggatacaaacacaactcacacaaatctgtacccaaaaaccaaggcaactcacaaatatggtgtactttaaaatattgtgaaggctatattaagttaaggatataaaaaaaatactgtattaattgtttttgttatattgagaatgagtatattttaggcaagggaatgaagttttttcatgataattagttttatattttaaataattaattgctaaagataaaatgggaaaataaaagtttttggaaaaataattcaatagctttcagtcgtaagtaaaatttttatttataataaaaacttttgaaacacgggagaaaaaaagtttttcatattaatctcgtttaaatacactttatttataaataaaaataatctcaaaagcaggaaaaacttcttaatattatatatttaaaaattattcatgtcttctttctgttattaatgaagagacttattcgatataaattattcatttaatatctaaatatttttaaataattagttgatgacagttattatgtcaagctttcaattccagacataggatttcacaaatatcctttcaaacaatttgaattggtattttcagtacatttaaaaatagaaaaaaagaagaagctctaagcgataatatgttgtgctctctcgatctcaaaataataattgttctaggttatgtttatataaattaaaataataataaataaataaaaataataaaaatatataaaattaatcttatcatcattaatttattttatatattttgttgttcgtcattaattataaagaataaaataaaaaactaatatatatatattaaaataaaataataattatttttaaataatttttttctgatgataagtataatataacggagggagcatttgattaaaataacttaatttttaaatatttttatctcaaaatgtacgttatggttaaaacttaaaaagagtgaaaaaggtggaagggaatagaacagcgtcgtggaggatgttgcaaagggataacatcactcactcactcgcacacaatagaatcaaaaagagaaaacccaaagaggcagaagacacagaagagaggttcaacgtcttcatcatctatggcgacgccgaattctgacgcaacctctcagactcaagattccgacactgttcccgattccaattctcccaacgccctcgtccccgccgctcccgccgtttgcctcctccgctttgccacagactccgccggcggcgctctcatgggctccatctttggatacggttcttctcttctcttctctcctctccgtattatcgcattacgccgtcgtttcatagactaattaccgtttaagcctaatttcttcgttcaactatttagtcgaagatttactgtttctgtcgatagtatgttaagaattcagtgcttgaattcttcttcgaagatttactgattttgcttgaggatgcatgttatggtgtgtttcaggtgctggattgtttaagaagaaaggttttaaaggatcctttgtagaagcagggtcttatgcaaaggtacattgagaatctcgctgcctttttttcctgcttgttttacattggatacttggttcatatgtaattttttttgtgcttcaattgagcttgcaattaattatgttgttctttttgtcattagacatttgcagttttgtctggagttcatagtttggttgtttgcatcttgaaaagacttagaggaaaagatgatggtatgaatatttaattataaaatgtgtcacttttgctttttagtgaagctctggtaatgtgaattcttttgcatctacagtcattaatgcgggtgtagctggatgttgcactggtcttgctctaagttttccaggtatcttttatttatttatttaaataaattgataagtttgtcctttctttgaaccttgtaagaaaaaattaggataaaggacttgtcaatctgactattctgaatatgcaaagaaaaaattaggataaaggactttttaagaaaaaaaaactacttaccccatcgtccagatgctccttactatatagaaggtaaggaagagggatattgtacgcaatcttattcttgcatatgcaaagaggttgtttccagattcgaactcatgatcaacaagtcaccaagacacaacttgactgttatgtcagggcttgtcctcccccaaaccatcacctaatatggagaggaggggggaaatttgctgatgcagaatgccttccaataattgctattgttaaaattcaattcattgtttagctaaatacacgtgtaaatttcattttgtatactttttgttatcaggacttatattctaggattttacaggtgcaccacaagctcttatgcagagctgtctcacttttggggcattttcttttatcatagaaggactaaacaagcagcaaccagcacttgctgttcccacatcctggaaaaaacctgtgcaacacaatgcacgttcgcctttggtactgccccttcaactctctcttccagatgaactaaaagatgcgttctcctttttctccgattctttgaagaagcgcagcaagggaccttatcctacatctcgataagagattggggtatcgtgattttctagcatcatgtagataagatgtgcactctttgccttttatttttgtaggtttcttgtagcggttatcaacatttcttttttgatgaacttaagggtgacaacaaattgtcgaaggacatgattatttacatgttcgtggtttgttgaacttggattatgatgactgatttaggttgacccgtgcacttactaatataataactgttagtattaggtgacagcgatatttgtttgaaagttaaactctgcaattttggaatttttctggttatacatgttacatttacaaatttatgatttttaattagaaaattatgtttctgatcttggttggaaatatacttcaaaagcatataagcacctagtccttacttgaatatccatttattctaacaacagcacatatcttatcaaacttggtacaaatgcaacttgattacgtgattgaaatgtagataactgaaatctaattaatagtgtcaactacatactacatatactcaagttgttagcctttcaaatgaccaccacaaaaataaacaaagctaagttattttaatagtgatgtttgttatcaatgacaatttcacgttcaggtaagtatctgtggtccatagaagacggaatctgtcgcggcggcatatgtttgcggtggcatccccacccatagacggaagctctttagttgattcctttgtaaaatctaatttgtcacttagctgcaaataaataaccactcaaattgattcctttgtaaaatctaatttgtcacttagctgcaattaaataaccactcaagttgattcctttataaaatctaactttgtcactaaatacttataaaaaatttctattaacttattttatgttggtcttcaattctcttttattccatctcttaatataagaattatgtatccgagctattatctaattttaacattgctatgtggtaaatttaagtttgttttcacttaaaaaaaattgggtttgtttagaaaaagatttttatatacatttataggaaaataaaataagaaagaaaaaaaaaaactttttctaaactaatttgtaaaagttttcatattagttttttcaatttttttaactttcctctttttagtgttaaggtgtgtttgtattcattttaaaccaggttgaatgtgaatccaatatgagaggaggattcaatgtgtttcaagaagttttttttttttttttttctttctaaataacaatcctatttaagttaaacagttgacaaaaactttcatttaaagtaatatgcattaaaacaaacacattattagataaatacatgttcctacatgaataatttataatcgaaaatttaaaactctacattaatgttccctcttcataattggtcatagttattttataaatactactttacttttaaaacattatgtgacattagtcgttcttatttaactaagctacaaggtgtcgaatttaagtaaattcactcttaaattattttataattaatataaaaacttacaaattattttatttattattaatgattaaaacttcatagtttaacatattataaatacatgataaaatatttacaatgaataatattttaatagataatacaatataatcaataacacaaacaagtgagtgcatagattatttgatacttatctctaggttgacattaaatatatggtaaagaaaattatgtaatccttgataattttatttacgtcaatccgaataaaacatggcgtttatgtttggattggtgaggagtaccatcgcatgcagttgacaatcaaagagcattttcttcagaagagcagaaatcaacttattttttctgcaatgaagtctgatgttagctattagagagggttaagcttctttcgtagaaatgtatatcaagcaaatatggttgctgcagttcacgcatatcttttggttgctgtatgcataatattatcatgcaggggttgggagatattgattcattttttttatcatgatatcactggtttgtttcatgggtagggatgtttgtttgtttgtaaacttttggccaagttgtccacatcttgtgaggctgggagttataattagtcagtttacttttgcagtttttaccaaattatcaagtttattttgtaaggagacaaacgaattttacagcttattacctagttagggcagcaaattcgtatgttgatttaccaatggttgttgctgaatagatccatttggaaataatataaatatcttttcataaaataaataaattaaatgtaatatcgttttcacttcctaaaactgagcatagtaatcaacaacttgagcctcatttttttttcctaataatgcaactttatttatttaacattaaattacatgaacatatatcaaatttaaataattaaaatgtccgtaagttttaatcgtgatagtatatggatagagaaaatataaattataataccaggggtacttatcaaattaattccacaagcttgttctgtattagtcacttaatggatcaattatatagaaaaaagatttttttttcgttaacaatcacctcaaatcattattaataaaagggtaatatagttgtaaaacttttttatacctaaaataaaaggtactttatgtcatactcggcaggtaatttgtaatttcatggaaagtcatgtaaatgaggttgatggtttgttcactttgttctatccataagattagaaaaacttttattcaacttttttttttttatgtcaattcacctatttttatttttcaaatggacccttgtcttttctaaacatgttttttgatatatgtcttttctaaacattaatatatataataatggaaatagtaatatgtatttttataaactctatgatttagtaaaatcttacgcttacttaattaaataagagtgagacatgaaattttatcgtgaaagttttaaaaaatgttaattatcaaagaatatgttggtattattcctttcctagcgctactctttcgatttactaaaatggaaatgaatggttagataaggtataagaataaaaaggtttttattaacacctgtggatttaaatggcaagaaatttggtttatcttgagtaacgtgtcaggtttttttaaaggattataacgagaagtttaaaaacaataaaaaaaaaaaaagaagtaaaaataacaagtttaactaactagaattttaactctgcttttaacttactacatctggattttaatttacgcatacatataatattgacataaatataaaggtaaaagggatagaaactcttcgcctaattcatacattccaatatacatcagaacttattttgcttcccatctttcccaaatcaaccaacaaatgtgacattaaataaaatcaataatcaaggctaattgcactttcagacctccaatgtctagctttctcaaatccgttggtatagttctcaaaatcatcaattgtttggtcaatctcttcctgagtattcatcacaaaaggtccaaattgcaccacaggttcacccaatggttcacctccaaccaaaatgaacctaaggaccttagaagatttgttccatgcctctaggccatccccaggaccaagaagaagtatatggtgagaggttacaagttgagacttttggtttccaaatacaccctctccttccaatatgtacacaaaagcattccaagactttggtataagttgttgcaagtgagcaccaggtttaagagtaaaatccaagtacatggttggtgtccttgtgtagattggagactttattccaagagcttcccctgctataactctaactttgataccatctatcatagtttcagctatgtccttgctcaacatttcttggtaccttggctcaatcctataagataatagtacaaagacatattaaaccaaagttttagagtctaaatgaagaaactactttaccaatttaacgtaaacttcaaggtagacaataaatgcttcttaaaggataacaaataatacttccaagaagacactaatggaaaagttgaattcatttttagtggggcatccataaccagacaaattttgaactagcattggcaacatgttattattgctcttattattgaagcttccaccatcactataggatatatggggtgagaggcacattctttatgctggccatttaagtcccttttgcacacttgcatcttttgatgccctatttaagagcacttctaggaaatggtacatgatggcgaatcatgaggaaaaagtcacatgtgaaagtaaggaaggcatatcttaattcagaaagttttaaaagatttgactgtttctttgtaaagagtgaagttcctttcggtctcgttgatatttggtgatgaggattatccaaaattatcccccaaaccaatgatgatgatgatcttcaatgacgcagaaagtacgtcatctaatatggctaagattgcgatttgagtatttcataaaaaaataactcttggtcactcttatttggagctttttacattaaaaaattaaattctaggtataaatgaattacaggatatctataaaaaaattatttaatctatatttagttttgtgtccactccaaaagtgcgtcatcctgaagcaaaaaatagtaacttttgtgtttttttcattcatttgaaatgattttgttgataaacatatatatatatatatatatatatatatatatatttgatgcttatccaaatacacttacaaaaaagacttatgaccttttgtaagttcaacaagtacttaattaagttgtttaatatttatgaatttttgtaagggcaataagtatttaattaagttgtttgttgataagtgtctctaacattggtacagaagaattgtccacttacattttatgttttgaagcaagattgatccacagctgaagacccttttgggttccttgagctgcaggcatttctgagtgaactatccctctccctgcagtcatccattgcaagtcaccagcttcaattgttcccttatgtccttcaaaatcttcatgcgttacagctccctaaattgcgcaaaaaagttgcattcaggtgaggctagcacatcagcacaagcatatgtgaccaatatatcacgtacacaactttagatacattacattacactcaagtggtagttggcattctagaaaagcaaacaagatatcaacatgtggggtcactcttgtgtttgtgcttataaccaactactatttgcaatcaggacacaatcttaaatggtatggttttagtggtcctaatcttaattggtaacgaatcatcaatttgtgacttacatgttgccacaccaccagcacaaagattaacaccatattgagctgatacttagctcaattaaaactatgagctaatatagaataaagaaatcataaagcgaaatagtatttagtttacttttaatttttcgtttttcaattttgttgatttgcataatggccattatattatatgcctttgactttataacacggattggaacaaaaaatgaaataactcaaaacgtggtttctctaatgttggaaaacagttttatattataatcaatgatcaaaggaggaaaagcccatgaactaaaacaataaatatttgctctacctgcaacatgtatgtgaccgtctcaaatcctgttgaaaataaaaaccaccacaaggaagaaacaagtcagaaactaagcaaatcagatcattgaagaacataaatgacacagaagattcaattggcaaacctctatgtggatgatcaggaaacccagcaggagcagtcactgcaatatttcataatttcacattcttagaatacaatacaagattgaccatcatactttttcataatccaaattaaaaaaaacagaggaaaatacagagatgcccacctgagaattcatccaaggcaaggaaaggatcaaagtacttgagttcaaatctgaacatatatacccacaaaaccaatcaattcaaaaagctcaacttttaaacaacttgcaatactatacacatataaagttaatctacacctttcaaccttaggatccaaattaatcttagttaaatataatcataactatgcataatggctaaggctaagattaactgtgttatcgttgatctctctttaagtcttacctccctatgcttcttctaacaacggctccaacaccctcatgctgaggtctggccaagaactttctggctacaagacaaggttcattaatgcaactgcaaatagcttggtccggcattttatgaaagaagtgcaaaagagaaagaaagaaaaaagtttatggaatgatggaaatgtgaggagcaagacaaagattgttgaaggtatatataggaaagtggggggtgtggcgtgagaaagagaggaagaggttcactcttggaaagtcaaactcaaaacgttgaggtcatagcatagaatagaataagagtttgcttgagctgaaggttctttttctttccttgttcctatgaacgtcagcataacgcactcatgatgtgtgatgtagtgtgctatgtttcataggaataggcataggacttaggaattttttgaattcatatagtatgatatagtatcttacttgttacatgattaccacctgtcatgttgaattgtgtgattttctcttcaaatcaaatttaaggctcataaatatcatataaaggcagaagagaaagagaaaaaaaatcttgggtcctagatggatttgtgcctctgcatcatcacttgacaattgacatcacccacgtttcacaatcggttaattaaagtcttgacttgtttttaacaaccttcgcacttcatcattttgttctactttacaattttcggggaaatgggtatggcctcttttgtttgtctatttactctttcttataattttttaattaaatttaaatggttcaaaagttgagtacttttttctttttcttttttttttctttttagttttattctttgtcctatactcggtgtcaaagtattaaaaatattcttttcgaatctctttgttccattatagatgaggttaaggttaagtttgaaagaaacaaataggtaaattagttgaactacgcataaacacttaataataacaaaaagaaattatgagttaaatttaattctcaaaatgaaaattcttcattcaaaaataaaaatggaaatatcattagttgatttaataattaagcttctattaattataaataaatatgttgaactttggagcataaatttaatttaataatatttcatatcatttatactaaacaatatctggagcatttcaaatgattcgattatacttaaaatgtgatttgagaataataatttttttaacgcgaggcgtggcttttatcatataaatatattttaaaaaaactgcttaaccatatttacagaaaaaaaatataatcgtaactaatatgaaataattttaattataattttaatttctgatgtatcattgttctatatgtagtacaaaaaatgatgcaaaaagttacttgtgtggttaaaaaggttctcaaatcaaattaatccccatgtgaaaaaaaaggttgatttatgactaaaaatgcaagacgaagtaaagtgagatatgggtcaagaaatagtggtccaaagcgtgtttggtgtaggcgattacatagagaaccatctttaaggagacacaagatagtatataaaactttaattattagtatatataattatcgaaataaaaatttatataattaaatttttaattaatagttttcaaaaaataataataatagaatgatagaagataatatgacaagtgtatatgtgtatatatatatattataatatctatacgttttagaatatattatactcctattttagaatatatttttttcctctttcttctcattctctcttaaattttttttggagtcaataatcaaatataagcagggttacgaggtgtgaaaactacaaccttcaagctcaaggctgagaataaagaagagatcgatcaagataagaagtatagagggaaaataacatgtttatatgctcaatggttttatgctaaataacaacaatatgacagtgaacaaaactataatttatatcacaattgatgattacaaaatattttatatcaatcgattaaaaaatattttatatcagtcgattaaaaaaaaaattcagtttactacattaatctcttatatttcaaacaacaataagtttcatggttatcttcataatcaaattaaaatctagtactttaaaattttggaacaaattgagtttaagttgaaggcttaaaatagcaatcaggtgccattgtttcatacattatatatttaattattagagactccttgtttgttttatagattataatttgtttttttttatacttgatgtttaatgttcaaaacatgttttttttcttccacaaaaaacatgttgcttagaaacaactttttggtcatttaataaaacggaaaagaaagaaagaaattgctattcatactgaatcttaaaatgtttctcttcataattgtttttttctaacattatacaatttctatttagaattatgcatatctagataatttagactttaaagttgaaaatttagagaataaacaactaaataggaatgatgaagaaaaatatattttggttggaaacaatttaaatggagacgatcattataatgaatttaaatattttgatgacgtgagtcttaaaaaaatgaattctttcttcttctttttttatgaaacctagccagcatatattattggacatttttttttttacctaagaacatgaaataatcttataagtaacttacgagattaatcactaaaaatggtctaagaaaatacatcaattgtgaatgatcttaaggatattaaaagaaaaatgcgcatgattttaaataattacgtgacctctaactaataattttagtcaaatgagaaatttttttattatgagaaataagaactacaaatacaaatcactaaataatatttgaatagtcaaaatattcaaaaaagtaaatggtttttttaaatggtcatgtaaccgctaactaacatataatcgatcctaattaaataagaattcttgttattgtgagaaataaaaattacaaatataagtcaatagatcatattagaataatcaatagtaaaagaaaaatacacatatttttttatgtgtttattgaagtctgaatcatctatataattgtatgaactagatttagagtttttatttcttacaataagaaaagtattttaacttatacattacacatgataaatttttatttttatatagttaaaatttatagttaataaatattttttaatatataaatcgtattataaataaaattataataaacaaatcttttgaatatattaaccatatcttggatttagatgaatgttaaacggtcgacaagcacatcgaattatccaagtaataaataaatggtaagtctgagtgtcgaattccacaatgattttgcttgtattcagagttaatatatttttaattttaagcgaacacaaattaagtttgataatttctaatcctaatgcggaaatgtaaaattcaacataaataaagataattaagcataacacaataaagagatagaatacaaacacttgagattgaaatgtcaggtaatgcggaggattatgacgtgttggggctcaactcaccaaaactacctttgatgcaatattacaaatatttctctgtttaattattaaaattgctcaccatcatctactaatgtgttataaccttaattcctcaagtgttaggtcctaaattacctaatttcactcctgatccctcaacaagttccatcaaataatttgcattaagagtaaagatgcaaaatgtaacataggctaaacaaaaccactttatccctagacatgatattatttagaaatgtttttcagttctcattttccaatgcattaaaatcctataacaagcttgcaaataggagattaaaccacaatcatgaataaagctcagaaaaactacaatgatacgaaaataacattaaatagatagttagaatcattacatcaagagtgtttggttgttggaaccccaacaatggatgggttagcctcccatttccatgagagggtttacaaatacaaaagaaagcaagaagaatgaaagataatagaagaaaatggatgaagaggtccccaaatgagtgagatttctaccttcactcgtgccctagctctatctctggccctccaaaagtccagatcctttgcctcgtgcccttatttttccttttaacagcaacccaaagtcgtggtctgtgctcagtgcggaaaggtcgcgctgagcacgccttcattgtccagctgaataagtgaccacgcgctaagcaagctggtcgcgctgaccgggcctgtcgcactgagcgagcatctggcgcacttaacgagtagcttcagacccttaattgtcctttcattttcttgcagtgaaatttctacaaaaacacaatcaacaacttatgaatcaactaaacttaacatctacttgataaaagtttaggagaagttaatttctatattttaatcacaaaaagaagtcataaaagaatgaaaaaaaggataatttacttatagatttacattcgatcagcaattatcaatgaataatttaaaattgatataattaaggttacgtttaactatacacacatgtaatgacatattaagccacatatcaatctcttttttataggaattgtaaactgagaacataggtataggccaaattaaaaatgacatcacatatcatgaatggagaacaataggatggcctgaatgaagaactatttcacatgtaattaaggacatttaaaagctattttttgttgaaaacaagtgtcttgtacaaggataaaagttaaaatttagcctaataaatatgaatagaaaaaatataatttgaaacgtatatataaaattttattttaaaattattaaagaaaaaattaaaataataatcataaaaaaagcttaaatacctttatagtccttataatttaatttttttatccatgtaaatttttttatattttatttttagctcttgcgaattatgtttattttatttttcatctttacaacactttagatatcacttttttcattatccaaagtattatctaaagttatttaatgattaaaaataaaacaaacataatttataaggactaaaatcataaaaataattttataaggatgcaaaacaaaaaaatattaaattagaaagattaaaaagattttttaaatgaaaaaatatggataatctcatccatattttgtttctgaattaaaaaaaaattccaaacatttagcaaaacacattaagaggaaaaaagagtacatgtaatcacgttgagatgtctaaatattatataactttgttaatgctggtacttatttagaaaacacatatttatggattatatttggatttttctttgaaaaactcatcaaattaagttttaagcaaaaaaaaaaatactttttgttacttttgttcaaattatgatcttggaagatttaagtggaaaaaaaatcgattatacgttgagtatgtaaaacagttttattttaacacatcatcacaattataactcactattaagtttattgtcttttattataattattttaaaaatcatagtttgtggtaaaggattccacagataaacttgattattagcgagattttaaacatcattctcgctttataaaccaaatcactgaatttgtacacgcaattatcacttgttagagggatgtttgtgttgtgctattggcatagacaccattattgtggcataagcatgataacaaatactaatgtttgagtcatatctttcatcatcaaccgctcagcacctcatgtgggaggaattaatcaacacgttgaaaaatgggttttatgaaaaatacggtaactatacgaaattcgatgaaaaaccccagtcatcttcaattatgcttccattccatccaaggtaagtacaacaaaataaagaaaaagagggggaaaaaaatgttgaataaagtgatcacttgatcgcggcgtgcgtgtattgttcatgatgacaaacacggtctaagactaaatcccacagtctacactctacacgcaaataagggtttattccaatgttaactatgcaaattaaaagagttttaatttgttcaaaaactcaattattttgggaggtatgttcccactgaatcaattagcctagctattattcaccgacgacttttctttttctctttatttttcttgggtaaattctttaatctcagtttgtatttaatcatttgttaatataatcattcaatgatacattgacactttattgaaacaattaaacttgctaaagaattgttgtgatagttaaaaaaagttcctccgcataaaatacctgtagtctgaaaagaattagtattatctgttttctttgcatctccttggaatcttcagattgcatttattagttgaaatttgaaacttgtttctttcttcttctttatgtggcagtggcaccagccgtgacaaactggtaagcaatgttgggtgcgagaaaaatgacatcattagaacaaaagcatgacgcgtcccataatcgaactcataaattcaaaaatgccatggactagtaaagtccacattctgatgagtaattgagaaggaaaaaaagttatacaataaagtaaaaagagaaaaatgtaatagtaaaatctctcaaggcagaaaactgcaaaagaggaaagtgtatctgttaatataagaagaaatggttaatgtaatatttgcatctatcaaaaaatgatagtgtaaacaatattttggtaataaaaaatcataatgaaaattaatagaactttaaaagaaaatttttaaatgaaataaaatatcataaacttgaagttgtaaaatatatattaacataaaaaagaaagacaacaaaatatttatatctctcttaagtagagtttaatttattcaaataattgtatcttaatccattgcacataccattgaaatgggttatttacatatatttagtaagtatctagtgttaattatgcatgaaattagagtttgatgtctatgtattgataatgtaaaactgttttacacttcatttaatcataaatcaccatttgaattattttaaaaatcaacaaatttatcataaataattaattatgattaaataattgtgtaaaacattttacactaacaatacataactttttttttctcaattactcatcagaatataatatattttcatactttttcaaccaaatcccatatgtcatatattattaacattgttagtacatatctcaatttttcataatttttttataatatattttcagtcctaaatttttttctccactgaatgttatttttagcctttttatatattactaacaacgttttttttttataattctaataacaaatttagttacacattttatcactctcaaagcttttactttgcttgcaactccttaagaagagaaacaaccttaatgtgtagcaagaggtgaatggtaacttggtaaattaaaaatactttagtataattttaattaaaaatatattttaaaatattttaaagaatattctttaatgatattaagttaaatacactaaaattaaccccattaaacattatctagatatcatgttcttttcaaatccatacattatttataaaataatattaacaatatctttttaaaaataaatattaacaatatctgtaaccgttactaataaactttttatcaatagtagcagttaattatatcttttgatgcctgaaatattttttgcatatctcagcatgagctgagaataccccttggcagttggcacacgtatctgcaaaaattagactatattaaaatatctatataaaatgataagcacaagtattagctatcattatcatgattgccctactaggaatcagtcactagaagatatgaattatgaattatgaagcttgtgccaccaaaatcggaaagaaaacatctaacgtgataactgactatatgaattatgaagcttgtgccaccaaaatcatacccaactcaaattgaaagtgcaatttaggagtaatccacatactttatgtcttcttaattgggcatatatatgtttctcaaatccacaatagttcatataaaaggagaaacaatagtgaattattccacttgtttaccataacccaccatacttggccattattgcttccaatgctttgtcgaagcagggtttgtaataaggaacacaatgattattgctatggtaacaaagagatagcgtaatgacacccctcaaggagactcctaagtgggtgtaagatatgcaatcttcttagtttctagtttctgagtttattagtataatttaagagtctgtttggatgaagcaatttaaaattataaagaattttaaattttaagaatttcaaatgcttcaattgaaattctttcattttcaaaattctgtgttaggataataaaattaaatttcatcattttcaaaattttatatttggatgaagaaattaaattttcagcatcgttcaagatcgtgaacaagtgccgccacacgatatgctcaagattactctctctagcaccatctcaccgcctcatcccaccatcagattcaccctcaagagaggcaaatcaaataacgtaaaaatcctgaagtcttggtcgggtcggatatgggcacaaccctctacgaccaagactctgacaaaaaattctcttgcgccattgctgattgcggcttcggcaaagtatagtgcgttgggctgggtcaaacctccgacgacattggcagagttcactctcaatagtgccaatgggttggacttctacgacgtgagtttggtcgacggttacaaccttctaatgctgattatcgccaaggacagcaccaggtgcagcgccaccgattgtcttgcgacttcaacggcgggtgtccaatttcaatttcaatttcaatttcaatttctcactcttttagaaggaaattaaaatttcacatttttagttgtttaaaattatattttaaaatttaaaaaaaattaatttcttaaaaaaaaaattcaaataatgaattttagattattttcttttaattatctgaatttattttactcagttgaaattctctatctaaacggacttgagaaatctcaatagaaattggcacaattttaaatttactcattaatagcaactgcaattaatcgaaaagatgacgccaaaaaatcttctatggtagtgtagttagtgcctgttgaaatcacgaattcaaaatccagctaaagatccaccattttgtttagtattgtcaaatcggggaaaccgacccattttgtgccactcattgtgagtaaagtcaaatataatttgttaggtgcatgtatcgtttaccttaccgtacacatgttacaatttaacaagtagtcaagtactcgtttgataatgttcaaaagttactaaatatgctttaaatttaaattatttttaaaagacacatttattctccatgaaagatattttttctcgaatcagatcatattactacatgctgaaagtaaaactttttctttaagtatttagactatatatagtcaaaactcaaacacaagagacacggattaaacaataataactatgcaccacattatctatgtgtttagtggttctctaattttaacttgttgacattaacatacatttttttttatcatattataagtataaagtatccattaacaaaatatttaatatatatttatataattatgccaaaaatgttattttttaataatttattttatttaatacaaaacaaactaatttgcaatattagatctaatgtaaattactattatttaagttttttttttttttcaaaacgatatttaagtaaaacttagtagttgtacaaattttttgacatcttcaaacttactaatcaagccagctcaaaattggttccggttgaattggatattcagtatcgctatttgttaagtacatttagaatcagaagggatagtaaaaattgtttatattgaaacaatcaaaccatgtatatgctctagatagttttcgggaaaattgttaatctaatgccaaatgcaccccaacaagtattaaatataaatatatcttacaccaaaagatacaaaatacacatctaaaaagaattcatagatatataccacgcgggcttttgtgctcatagtatccaacccgagaagcaattgaggaactaagaatggacaagcgtagctacaacaaataagattgaaagaatttgctccttttaagaagaacaaaaaaaaatgtggattgttcatctagtctgaagccaaaagcttcatgccactcaaacctagaagagatgtggaaaatagagggttgagaccaccaaaagcaactttttctccattttttttttttttttgttttttcttagaaggaagtttagagatgattttactcaaagcagaagaagagaagctataaacacagcgagagtggacaagaagaagcagacagtgaccttaggctgtgaatttccctgtggtgatttggttccggcattcgggctggaagctggggctattttagcaacaggaggcaaaggtggctctgccacttcagattctgtcaagggtggaaacggagcctcggctggaggcaagaattctttggtaatgagtccaaaaagaccacctggttgaacaggttccatgtaagtaggtttgttgtcacccaaacctaagcatttgttccctgcagtagaacggagaaaaattatttcagtaaaaactgtttatattgaaacaatcaacccatggtacagcagaatttgctagcacttacttctgtatctgtcagcagttttagggaagtctgtgatgataccatcaatttgtgctccctcaatatatgagttgatctcaacagttgcatctgagaagaaatcccatgcttgagacacaaactcattgctgaatgtttctacaaaaactgagaggttagcattttttagctttggcacaatatttgtataggccgtcaggaattgatcattattaggaattacggagtccttgttgacaaccacagaactagcaaagttctttatatcctcaacagctgcatttgcagcatcaccaacagtctcgtcaatcttgtacacaagctcataactggttttctccttgaacttcagcagtacagaactattagtggattgaatataaaccttttgggatcctggtttatcataacctgctttgctcaaaacatcgatgacagcatcaatcacacttaatccttgcttgtctgcaagataggctgcattctgataagaagaacaacaacaacaacacaatatacatgttagtaaatagaagatgaaagaaaaggaaaaaaaatcatttgcacacaaggaacatgccaaataattctttacttggttgaaataaatcagggtgaatagagtcagtgaagaaatatttgatgttaaattcacacgagtttggcaggtgagtcattttgtttttggtttcaaaagagaaagttgtcagctgcatgaagtacaagtagaactccaaagagttaaaaacagtatatttcataatttttggccaacaaaaacaagtgagaaacaggtcttgtaacaatttgatagaaataatgcatgatagtcttaatatttcttatttctatttcccctcttattccaaggtgaaatcattcataggaattattaaataacttaagtgaccctaagccgttctcacaaaaatttgtcctaattcttcaaacaaaattatatgttcaaataacagccggtagaatgaatactacaaaaagaatgaataggcacggaagcacacacctcaacaatgatagcaacacctgatagagaagtctgattttttgtcaaggacaagaaatctgataatgccaacaatgtcccagcattcttagattttggattcctgaacaatctgtattttgcaaaaggattcaatattgaggctgcagggaaaatagagaagagaaaaatatgtcaaatatttgttataacacttatcataggcagcaagtgaaaggcaccaaaagatatgagagggaaaattttgccatggtaatttatcagtgagacattaattgtcctataaagtgaagttgtaagctaatttccccattattcccaaaacacgacttgtttcaatgttcatatatctcattctgaattttggctatatgacgtatcagtcaactaagctttgacaaagtagggatgccaaattattgattccattaggctttttgcttcatgggtttggttcttgtccccccatctgttgtttttatgttcctcttctttttggttaatatatttccagtgtgcagtaagtgattgttagttgctttggtgccaacatagttgggattaaagaaactaaagtgatgcatttgcatgctgttttgtttaaaaaataatattgtgattttagtccccctagtttctcaaattcatgattttggttccctgaattttaattcatagtcttataaattggtgattttggtcttccagatagattattaacaaataattatcattaattgagttattaaatcaattataaattaatcaaaaccattaattattaaaaattgaataaaaattattaatcctaattttctgcaacactgttcttcctcttctctgcaaatacctcttctatctccattgtgtcgcacgcgactccaccagcagtaacaccacattaggtttaatagtgttttatcaaagcctttttaatgattaataatttttatttaatttataattaatttaatctctctaataatcataattattaaccaaaatcacaaattcataaaactaggggaccaaatgttacaattaaaaatcaaggggaccaaaatcatggatttggaaaactagggggaccaaaattgcaattcagccaaaataataattaagctttgacaagtctggattaactccatgcaaatacagaaataaatagctaacaactacagaactttcagacttacgggtcaagctttttatatcattccatgtcaagttgaatgcaaatatgccactgccagatttgatctcggggatagtcatggcaaatttgctgaagcttgattgggtgactgttgtactctctataagatcaatggagtttaagcaaaatggtgttccatccttagacatttgaacaggacagtcaagaacatccacaccatcagatatggccttattatatgctaagtcggtacaagcaggataatctccactcgctccatattttgagataaccaaagttttatctgaaacatgataaaaaagtgagagaaacaaatcatcaataatgcaagctatgcttccatcgaatgataaaaatcatacagtcaaacaactagaaatcactaagaacaacatgataatacatattccaaaatcaaaacaagttaccttttttcgtagcattggtgcctaggtgagcaaagcaacctgcattataagaagacaacacagtatctacttaaatagagaaaaaaaaaaggattggaaacacaaacatacagacatgttctgagattacaatttataagtatgcagtaggacccacaagcgactaatatcaactacatgcttatgtcttatgcttatatgatgtaaaagcattttaaaattgagaaagaaaattctaattaggatagctaataagaatgcaatgcctagaaggcaaacatcgctatgtgctttcatgcagcatgacaaaatcttttactatagttgattaaagagtatataactggaccatatctgatctgcctaaaggagcctgccctaagctgaatttagtttacagtgggagcttgaaagcaggaggtggtgagagattggctaaaagtacatatttttagtaactttgttcatgcacttgcaccagcattcggacatgaaatcctttagtcaaagtcaacataaatcccatctgtatccttccattgattaaggattgcataacaatcttagtggcatactcatgcaaagtgaaagtatctgcttacaaagattggatagtaaggataaattagcttataaatatatcagttttgggcagattgatcagtaaaacaatttcactgaggattaaaattgaggatttgccccatgaagtttaaacaagccatccgtggccactctaaaattgaaaaggcaagcaaatgcaagaggcacgtttaaggtgattcacacaaacactatgagcatgagattaggaagacattaggataattttatttaatggaaccttatagctgcatcaactccatcccaagggacaaatactgtatatagtaaaaatctgaaaatatatgcaaggatatgtttggttggaagagtttgaaggggaagtgatgacagcagatttttcatttataaaatgtttacaaaaacgaataagtgatgattggcaagttacactataatctgattataccccccccccccccagttctgttatttaagaaaatcttaaataattagaatgtttacataaaacaaatattgtctcccttctaaactcttgcaaccaagcataccctacgtctacgtaaacaacattttgataaaatcaaatgcattctaattgtggcaggctattctgataacatggcagaataaacaaataaacagcttacctatagcttcaaatggagttatgggaaaatcagagagcacaccatcaacagagaagtcaccattgtctacaaattggaggtactcggcaagaggatcataactgtaattgaagctagatggaacatcgttcacaaaatctgatgcaaaaacttctagccctgctttatgtgcatctgagaccaaagatgtatgtggttgtagataaagagttgcatgatctacaggccatatgtatccctttggaacaagaattccagaagcaaatgtcttgataaatgtaagattttttaaaagcgaaccataagtccgattggttgatggatctacatcactctgtcccataaacctgaagaccaattttgttgtttttgggttgaagcgtgatgctatacttctcagaaaaccaacctcaggtgatgagatataactgaaaactactcttctagaaactgaaatcacaaagcttcgcatactcaaattgtgttgtgcgtagaatgcatcatgctttaaaatataagagaaaacaagagttagatttaaaacaaggagactgaatgatgagaatggattatgcattcattctatttacctgaatattcaaccatattccttttggtttttgcgttaatttaactaaatcatcaacagtaagaattccaaaattgttgccatcatacaggttggatcgagagtatactccctgagttactgtccagaaacaagaaactgtcagcaactatataaagaaacaacttccctatccaaaaagaaaaaagaaacaacttcaaagctcatttgcaagctgagacagaaaagggtttaaaaagatcctgattagaagctaaaccttaaatcaacaacacatatatacaccgcagaaaagaatcactcagtccatcaaatactgaaagtttataactattaggaataaaactacatgtttgaaataaactaaactcacagacaacactagataggtccttcagagtataatccagaggaaaatagccacgggtgggtacaccattaactaagtaacttgtggttttatttgggtaagcggttgcaatgtaagtagaatttgcaaggtttatatctggctggcaaatcccaactccatcttttgttaattgcacatcacaccatatatagacatctggtccactcgttattactgccaaattataggcagcatcactggaatcaggaagtatccccgaaaatccaccacgtgctacaaccaacggcgcacctcctgcaaaacaagtatacaagtaagtttcaaaacacctaacacagtgaaagttcctccttaaataataataataataaaaagtgcaaaagttattcaagaacatattctaaaactgaaagtggcaacagtctctgatattatatgaatcgtattcagtcagcgattggcctttagatttcatggaaaaaattgtttgttgaagatcctacatcagactaatgatatggcaaaaaagagtgtataaatagggggcaaccctcatttcttaagctagcatttaagattgaatatgacaacccaaattctaaattctaaaacaggtattggagctgatcctagcgatcattgttgaatctattgggtcaaccgttaagtcatgcaagcttcacatcgaagatgtctagtccttggcgtggagaaggctagctagcttttgaggttgagttaggctcaaacccaaattgtaagagttgaatccgcaaacagttcattcagccaaaactttccctgacaacaaataactaatgtttccttttcacatatgatattctcagattaagctctcgagaaacgtcaaactctttctaagcactgcatataatatctccatagaccataaactagctcgaagcttagctaagccatttatccaaatccgaactcaggtcaaagtaacaaacgaaatcaaagtttacaaaaaaaagaaaaacacagatcgtacacttggttagtgattattaggtaagtaaatagtaagtgaaaagagacagaagcaaagatggtagtaaaacacgagacattaccgctgagagtgttccagatagatctctgagcagagacgagagaaaggagcgagtgaagaagaagcagagcgagtggcgcagagagagcgcgtgaattccacatcccggcaaccttggcacttggcagattaagaccaggagcaagtgatgaacccaaccacctcaaaacttttagagagagaaagtgtgtgtgagacaatgaggtcttaactcagcagaagaactttttctgaagtggtggccttttagtattttctttcttgcatttatcattgtgttctgttgtgtatttacatatatatagtattatttaaatttttttttcactgatcaaatcttttcattcataaaatttgaaaacaagatctttaaagactgaattcactggaaccaatgactaattagtgttgttggaggtattaatattgtagtgttatttaatagtgtagtctgaaaaatataaataaaagtaaaaaaaaaaatgtggggcgaagtggacaagctggcttgagctaagccgcggttttgactgatgtagtatgtggtgcggagtggggtccacaacgtggttgtcaaactctggcaaggtatacgtggcgggctgtgattggtgctgaggaaacgcacaaaaccgcaaggttctaagatcatatttggtggcatcttcaactatttttgttagactatataatgttaatgaagatcttttaaaaaaaaattatttttttagtagtagattttattttaaaattattatttttaaaataatatatagatattaaaaattcttttaaaaaacttattttttatgttaaaaatctattgacttcatttattaaaagatatagtaaatatcatatattgaattcaatatttaatagtaaaaatgttctacgtgggtgtccaccgtagaagaacaacgtgcgaccgtgaattgcgactctgatttgatggtggtgaggtgagggtgagtgggtttcatttcatttttgatgctattgccgagtgagactgctcccactgcattgcacacttttattcgttctttttcaagtactttgtcaaagtccaacatgttcagaatatatgtggtattagatactacagttactcttcatcaccacttttgattattacattaaaatctaaccatagataagaacatatatctcgtttctttctcatcttcatgacaacgagtttgtggtcattaatttgaattgtgatgatggacctggtccagttgcataaattaaatgatctgtctatgtttggttttatcgtgttatgacatattgacgttgaaaactcattttgaggccatgactatttcaaaaggccaaatattacttaattattttagatttgtctcattaatttttattatttatttattaagcagtgatatacatataataatttttttaatctattacatcatttatttttttttcttctcttccgaaatttctctttgcatgcgctgaattatatatatatgtaagagtattcttacccgtttttttaatattagtggttagctcaccaaaaaaatatattagtggttagctggaaggctctttaaatgttcgtccttaaactagagaagaaaaaagagcaaggcacaaagtatacgttgcaccactttctgaattgtaatcctccctatccatgtggtttcaatatatatatatatatatatatatatatatatatatatatatatattatatttaggggtgtgaaaaagaattaattctgatggaatcggattgtaatcgaacttgaatcaaattaattttttctcgacttagtttaagaaaaaaaatagtacactatcttataaaactattttgattaatcaaattgtttctataaaatcgattcggttaatcaaactgaatttcatttgaatatttttttatttgaaaaaaatagttcgaaattggttttatttgttcttaaaatcagattaaaattgattaaaagttaattcgatacatagctaattttttaaaactagattgttctttaaacggttttcaaattaatttgactatttgaatataaaactgaatcgattaacacagaccaatttagttcgatttttttaccatactaatttttgcacaccttactattattggaagtaataaacattttatactctttttgataaacttttctttttctttttcaagtgactaaataaattataaatctcaatgaaaagttaatcagtttttcttagtgaattatacgcataaattggataaataagtttaatcaaaattaattaatacatctgtaatacattttgagtatggcataaaggcacctaagaactagaatttcaaggaaatagcaagaggggcaaatctgtgaagataaggtgaacaatgaaagacatggattgtataagaaggaaattattgacgggtagggaattatcagaaaaagacatcgagaataaagaatctaattcgatggttgttacttgttagtgttctaagacagaaacttacaagttagacaaactggagttatggcaacttaaacgagtttacttttcaatgaaatgctgtcattgcattattgatattgcatgcttggccagactaggaattttccttgttcctatggacgaattctctgcaactcttgggttactttttctactcaagttatattaatatattccttttgctttccaaaaaaaatgtagaagtttcaagatgaaaaatcaaacctaaatcccattgacttccaagtcaattctactaatgctgttagaaacaatcttaatatatatagcgttatagatggggtagaaaatggatgtttatatgatatataataaagaaaaagaaactccaaaatagataaaaaatcaaaccattcaaatacctatgcctcatctttgcagacaataacctccaagtcaatgtaacatagtggcagtaaagggaattaatgacacattatagagtagaaaatggaaaaatattagcgcagtgaaaggattagaaaaatgaataatgtttgtttgcgtgagggatgggctcttgcatctagtgtttttaatctggctataaatattcatctttggttgcttaccctttcaaataaattttcctttgaagtaagttagaatggagtcaatgtgatggatggggtggttgtttctgtgtaggcatttgttactcgagtctctaaatttgtgcaacaacaagctacggggcaatattccaaaatccatgttcagccttgtaaaccttactcacttgtgtctatcaccttactcacttgtgtctatcatcaaacaacttcagtggatctgtccactttccactcttctccaagcttcataatttggaaaaattttccctttcgcacaatgatcaattatcactaaatttcaaatccaatgtcaattacagtttctcctgcttaactagtttggacctatcttttataggtttatctgaatttccaaaattatcggccggtaaaagttccaatttggggatttcttgatatgtccattaacaaacttagtggaagagtgcccaattgattacatgaaatgatttcattctattatttggacctctctcaaaacctgttgacaacaccaatggaccaattctcaaggaactaccaactctattaccttgatattagtttcaactcaaacactggtggcatctcttcgtcaatttgcaatgcaagtttacttcagagtctcagcttgtcccacaacaaattgacaggcatcattccccaatgcctttcaaacttatcatcccttcaagtattagatttacagatgaacaaattttatggcactttacctagtaccttttcgaagaaaagtttgctcggtactttgaatctcaatggcaaccaattttgaaggtcttttgccaaaatctttgtccaattgcacagaagtggatttttaaatcttggcaacaatcaaattgaggatacatttcccccttggcttcaaactctaccatatttggaagtattggttttgcaagccaataagttgcacggtcccattcccagttaaagaccaagcatccatttcgaagtttagttatttttgatatctcatccaacaacttcattggcccaataccaaaatcctacatacaaaattttgaagccatgaagaatgtcgtccaagataaagtgggtaacggtttgcaggaatacatggaaacatctataatgaatggaacatacactgattctgtgactgtaacaatgaaagccattagtatgacactcaacaaaatccaaacaaactttgtaagcattgatttatcaggaaacaaatttgaaggagaaattccgaatgttattggagagcttcatgcactcagagggctcaacctttcccataacagactatgcagtcctattccccaatccctgggaaatttgacaaacttggaatcattggatctctcctcaaatattctcactggtaggattcctacagaattaaccgatttgaactttcttgaagtactcaatctttcccataaccatcttgtaggagaaatacctcatggaaaacagttcaatacttttttgaatgattcttatgagggaaatttggggttatgtggagtccaattgtcaatgaaatgcaacaatgaccgtgaacaacattctccatcttcaccgaccttgtggagagaagagaaatttggatttggttggaaaccagtggctataggatatggatgtggaatggtatttggagtgggcatgggatgttgtgtgttattaataggaaagcctcaatggcttgtaagaatggttagaggtcaacttaataaaaaggtgaaaaagaagacaaggatgagaactcatgaaattgtagcagaatgaattagtggatatctggcatggctggaatttgtcttgttcctcactttcctgttcaattccatttctgccttcttcgaaaacaaaaaacttaagggcaaaaagcttatcacattgcattgcaggggagatctgattcaaatttttgtaatatgaatgtcatatttttcatttggtataatttgtttgccttcgatcttgcaattttgttttatttaatacatataattgtcgatattggttatatattactagcggttgttgtatacttttaaaactgtttatatgtaccggtcattgctagaatatttgtgtcttaacattatggaattgtctcattttgttcaagtatttcatttcgcatcttcatcttctaatatagtctatttagttttctatacttgcttctagtgttgtttttcagccaagtacattatctatgtactcaccttaactaattgattttctagttttacattaacaaaaccattagcacaaaaggattattaaagatctccataaaaattctctgtgatctaacaatagaaggcagataagtgttttgacgaaagaaaagttcgatggacggttggactgcataacagaggttggaacttggaagatctgagaacacattttattaaaaccaatctacctgccaatgagaactttggatttccacatattctaagctttgatgtagctttgtccagaatccctttgaaggagtctctagccactctgtcattgatgtataagaactcccaaatattttccctaagttatccatcctaccaaaactgaatttagtgctaatctgatctctaattctccatacttggagaaaaaaagatctttatcttatccctgctaatcacttgaccccagctagagcagaaactgctaaatctctctaatgtgactcccgagttacttgttgccttgctattgattcttttttgttcttttggggcctttaatgtttgatactatgatggaattctcttgaactcttgtttgaaacttgaaatctaaacctgccattatgacatggttaagaacatatttacttcggatgttttcatcccacgtatagcttgttgtctttgtttaatgaagctagatcatcaattgggtttgagtgtcttagaaaaactcacattacttctactcatctcatactgatgcggaaatgttgtgaaggatgcattactatctatattttttaaatattatttattactattattatggtgtttcgtttattgagtttcttctcagaaccaagaaccaaacattttatataaacatatttcaagttccagaggaaaggaataatagacgtctggatattttgtagacatggagggaaaagagtaatgagattttgtattcttgtacattaaacacctttgcaacatctacaacatcaggcactaatacaccacacgtctacttgcaaacttttgggcaaaacacgttgattaaaatgaactgcacctttattggagggacatcagatgctgtcttaaaacttggaagcttctttaagtgttaaaatgaaacaccagacagcaattgaagactaagaggttcttaattgtaatggaaaaatctatagaggcaaggcagattgactagactgtgccatactctccttaaccaggtgttgagcttgcttaattctcaaatttgctcctttcatgagcttctaattgagacattgggctaaggtgtgcccaaatgaaccttgtcttcctgcaataagttcaatgaaaatatactgttagggatgtgcagcaatctgctgtggagatattccaacatttggcagtgttcagtggcaaaggataaagaaaacatttggcagtttaccaagtgccaacaggcttaatgttttcaagtttgaccttttcataagctactcattagcttgtttttgacaaattgcacaaaggaagatgatgtattcttatcacgatatactgtttgcattatactaaaaccccacaaaaaacaaccctattaagtgttcatggatgctttaatactataactaataagagttcatgccccagcctgcagataggagagagagggttggcagaaggaagaggtgaccaagttgccataaaggtggtatttgctgaagtacatttttatttctttgaaatttgatgctttgttgatttaagacctatgctccaatccaaaagtatgaggcaacctgtataaaggatttataatatttttctcaacaatctgttatttccctcacaatgttgacaactcgtgaaaacattgagattttaaacaatgttaaattgtttgtgctaaaaacactaccttgcacatgccgtatgtaattcagtagcatatccatccttgttcttctacaatgcattcctgtaatagttgtcttggaaattgagagaaatattgctgatggggatcatattacttggacttgtttaaatccaagtcataagtgtttttaagagtttttctagtaaagaaattcttaaaaatacttatagtcttgtatccaaacagactccttgtcttgatcagcaagagcattctttaacttaggctccaacagctattgggatcttgattcatcatacttccacccgttacattcattagtcacttgttcactttatcgaatacatgataatgagtagtgctgtaccatcacgaggagcttcgcgaatactgcaattccaacggtgacaaatatcacgggcatgttggtggtgtcaacaatcatgtcctttctcgttgttctgcttatcttccttttcttctccattattatgttgttttctctgaaactcaaaataaaggaatgaagctagtagacgaaattcatgcaggaaagaatgagtttggagactgtaacttcttattgttctttatccaaatattgagttcaattcatggatgtataatgacaataatacactaattgcggagaagagagctacaaaagttttaattaatgtcataaattgtaatgacaataacatacaaattgcaaaaatgagtgtcacgccatttaagcagctcgacccagagtactttggttttagtgacaatttcaatgaacaagagtgtaatggcaccaattatagaaacctttgatgttaaatgagagttattggaagaattatagaaaagaatgacacgtagcaaaacatgtgatgtaaaaaaattatataaacatgcaatattatattttgcaactctaaatttatatatggtaaatagataaatagtcaagtattagaaataagttacatatgtttggataatagtgatcaaaatcaagtcttataattataacatgtgttttattttaatacaataaactgtataagatattaattaaaaactatatttaaactatttaataatttaaaatcaattatatgtaactttaaaacaagcatccttcatctttttattgttttcagcaaagttaacaaaagatttctgataagaaaaacaaatgatatttaatattcttaaggtttaatttttatgtattataagtaaaaattcggtacctatcagtcatttagaattattgttaatttaatttttaaaataattattataaaagttattgcattcaatttttttaggacaacagtgaatccactattcattctttgaccttttttataaaaatataacagaattacgataaaattgaccatgctataaattgaaaaggtagtaatttgcttgaataaaaaattggacacgagatcttatggaatataaatatagcaagaaccttgacaaaaaaaaatgtaataatataatgttgcgtaatgcattgttcactttgtcacaaaccgaatcccagctgtgatgatgaacatgcccgccataacgacgcttgttttttgctgagatcacaaagtcggttccacaaaacaccaaaaaaactatacacctagagaacgacgtgtgcgaagcgtagagcgagttcaagatactctcgcggttaacccacgcgcgcaatctgaaaccaaaccaacaacaacaaaaaataaaaataaaaacaagacagtcatagactcatagcataggacttgggagtcacacggtcggttctcttctctgtcactttgcctacccactaagaaaaatcgatcctttcttctcttccttgcgcatctcttctcttcattcaattcaattgtggtgttagtgaaataataatgaaggggtagttgagcattcaaacaacccataccctcatttttatgtgtgggtatgttctcattattattttcattcactcattaacttcaacaaatgcatacaattactacaatgttgtatctgcttctgcgtggttctcactcaagttcttatctttcttcccttcttcctcgatctcaatcttcccaactggattttgctctgcggggggaggggtaaataactcaatacccatgagacttgctatactttcgttgaaaaaccattggatagatgtgaaatgcgtcataccctttttctgtgtttgatggaattgagcttctggtcattgtttttatgatggttttttttttttttaataactaatccaacgaactctcttatttcattttattttaatcttttgtgtcttatatcgttgttctgttttttttttcttttcctttttaagcttatcttttgtttgtgttgtctgtcaggataacgttggacaggttggtgactccgggagctaaaccacttcttgtttgggatttgttgtagatttggccttatatttgaattagaccgtgtagaattgcatctggcaataggttgttgagtcgtacgcataacgcattgttttgtgttacaaatattcttaagcttttctggggaatttttgtggtttgggggataccatacaatttgtagctttggtttgtgattctccaagatgtcaaaatttgagggtgttattgtctccgatcaatggcttcaaagccagttcacgcaagttgagcttcgcagcctgaaatccaaagtaggttcatttcattgcttccttgtaatcgacattttagtccaatttcattactcttttaaatttgttgtctttcatgctttgtgtttttttttttttttttttttttttttttttttttttttttttaaccttattggacccttctttctgttgttgtagtttgtctctttaaagaatcagaaaggtaaagttacatttggagatttgccgcctttaatggtgaagctaaatgcattcagagacatgtacggtgaggatgagattagggggatcttgggtgaatcaggcactgattttaccaatgacattgattttgaagctttcttaaaggttagtaatttggtgtttttgactttttctttttttaatattactacattaggtaacttttttccatgttgtgaacttataataatgggatattatgtgtaagttagttgtattaatgaaacagtttatgtgccatataacaacattaaatataatgttatgtagccttacaatttattacatttttcatgcaggcatatttgaatttgcaaagccaagctactacaaaacaaggtggtaggaggcactcctcgtcgttcctcaaggaaaccgtgaccacccttcttcacacgatcggtgaatcagaaaaggcttgctatgttgcccacataaacagctaccttggtgatgatccatttttgaaggaatatcttcctttggacccagctacaaatgatatatttgatcttgcaaaagatggcgttcttctgtggtatataagcagggtctgctgattgttgcattttacttatgtctgtatgagcctttaatgtatattggctttgatatatgtcgtgtttaatgcagtaaacttatcaatgttgctgtgcctgggacaatagatgagcgagccatcaattgcaaacggaatcctagtctttgggaggtaaacgagaaccatactctatgcctcaattccgccaaggctattggctgcacagtggttaacattggcgcacaggacttagttgaaggaagagtgagttttagcaatacgcacttcccctattcctctatagacatttacttaggttcttaatttttattctttgtgacattattgtttgggtgtttatgttgcagcctcatcttgttctagggttgatttcccaaatcataaaggtaaatatttgaactgcacatatcattcgtttattgttagtttagtggttgattttgcttatatgtttacatcatttttcttaatggcctaatatatcttttgacttcagaaatgattacatagtcattgttctcttttcctctcaatctcttggtaatttcagattcagctgctggctgatctcaaccttaagaagacacctcagcttgtggaattggttgatgacaacgaggtaataagatacgcattttttttctttaatttttatttccaattaaatcaaattttgatgtttcattctttgcacattgtgtttcaggataactgatgtattttgcatttcattgttgtcttaggagatcgaagagcttcttaatttgtctcctgaaaaggttctactaaaatggatgaattttcatctccagagagcgggttacgagaaaactgtcagaaatttttcttctgatgttaaggtatatgagtataggtataaatttgtacaatgagtattgataagtaaaaaatatatctattatataaggtacaaacattgcataaatgagtatcattgggcccctatatttaaaacaatcagggtacttttagcagatttttgatgttcaaagggcttttacaaatattcagttccctgttggaacttgggtgtctcccagtcctacttgtccttcataatctcatactattcaaagtatggatgttaaaatgtggtcttgaaaatattaattactgctgttctcctccccttaaaaaatctgcattgcaaattttggattttttacttattaaccttgaactgaacctgctaaggcttctctgctcacaacaaataatggttgtttgtaccttgtataatgcatatattttttgtaacaaattgttaatgtattcttaaaaggtaactgtcacatatattattcttatggggtaaatgggcaacatgaccataaatatattcatgtccatacatatacacacacgcacatgcacaccacactttgacagctagatgcttttagtacatatatacttgaataacaatcccgtctatcccacttcatggaatgggagtatctaagtgtgtaatgcatgacatagaatggaaatgtgacctttgaccatgtcatattgcttaatatgttttaagaggttgttcactcggcaaaaaatccaattccaatttttcatatgtttgttcctgcagaattgcaatttcttcaactcccaacttctaagccaatagtgtcataactcatgatagttttgcctctacaatttgaaattgaatcaagctattaacaaaccattatcctaatgtgttcacacccatttatttacaggatggagaggcctatgcttatctgcttaatgtccttgctcctgaacattgcagtccggccaccttggataccaaggatgccaatgaaagggcaaatctggttcttgatcacgcagagagaatgggctgcaaaagatacctgaccccaagcgatgttgcagagggtacttcaaatttgaatcttgcatttgttgcacaattgtttcatcataggtataaaatgaattgcatagttaattttatgcagactatttgataatttaaataaatattcttatgcatgttaatttctgaatctgtttaagtgctgtagttatttaattagtgccctacacattgcaggagtggtctatctacagacactaaaaagatgtcctatgctgagatgatgacagatgatgtgcaaacatctagagaagagagatgcttccgactgtggatcaatagtcttggaatttctacacatgtaaataatctgtttgaggatgtcaagaatgggtatgtgttccttttcttaaactgcatttattatttttggcaaaatctaaatccttgtatatctgtagaagtgtaaatttttaattttctggatctcaaaacataccaaatgatccacatggcacgtgtttatccactgattgggaaaaattaaatgaatgtgttatcaaaatttaatttgttaattcactaagttcttatgtgcttgattccttttactttatgcatgtagatggatacttttagaagtgttagacaagatatttccaggatcagttaactggaaacatgcaacaagacctccaattagaatgccattcagaaaagtagagaactgcaatcaggtcataaaaattggtaaacaactgagattctcactagtcaatgtagctggtaatgacattgtgcaaggaaataagaagctcattcttggtaatctcttcatatggatataatttactcttattttttataaattttttatgaccgctttcccacctatttgttttggctttcaattttatctaaaatatttttttccagctttattgtggcagctcatgcgattcacaatgcttcaactgttgaaaaatttgagatctcattcccaaggaaaggagatcactgatgctgatattctgaaatgggtgaacagaaaagtgaagagcattggcagaacttcccacatagagagcttcaaggttttttccaaaagaaattctctgttttatttgctgttaacaattcccaacaactgtaaactataaaataatgatttatccgtgacaaatttttgtatcaaattttttgcacaggataagagcttgtcaagtggactctttttccttgagcttctgagtgctgttgagcctaggattgtcaattggaaccttgtcaccaagggtgaaagcggtatgattctttatagggatattaaacagatcctttgtataacatgtaattacttgctactttttttcatccctcctaaattggcttaatttgttgtaattgtagatgatgagaagaggttgaatgccacttatataatcagtgttgcacggaagctcggttgttccatatttttgttacctgaggatattatggaggtatgttgcctcttgccacctgagagtttcattcatatttgctacaaaaatttatacacattagtcttctttgaataaacttcataagttcttataagagaaacaagcaaggtaaaataatttaaatttctcccgtaattaaaatcaaactttacacttcagcttttataaaaagttcttttatttaagttctccaaaagctaagtgtataaattgatttaaacttatgggtgaaatttaattcattttatcttattttcttcttctacaagtgtttatgcagaacttcattcaaacaaggccatcatgtaatttggcaatgataccaaaaaattaagttgacacattctgggttcagtttgtttatgatgtgattgattctttgttgatatcatggcaggttaatcagaagatgattctcactcttgcagccagtataatgtattggagcctgcaacaacagactgaagacatggattcatttccttcacctggcggcactgctactaccaccacgcccgaagcatccctggcaccttcggtatgtggtgaagatgaaagttctgccattggtggcgaattctccaacttgagtgttgacgatgccacctctgacaccacagccacttcttcacaacccgagtctgacagcgtttctgtgggagatgagctgttatgagtcatctagttggcatgagatgagtgttaaatgtttttgttaaagggagaatataacgagtaatgaacttgcaaagcttaagaaacaccttcacaatggtctcaaccttcaaaaaagttggggatgaaaacatacctttagaatagtatatgtgaatagtctgtacaaaaatatctttgttctttggagagaaatgcttattcagagggataagaatgaataaagcttagaggggaagaaagaaatgaatgtgatcaattcacacttgtcccttatattgcctttaagtaggttccactactgtatttgtattttgtcattcattacgttatgatggccaacaatggtgaccatttaccgtgtcaaataaacagaaaatttataactagttctcattcattcttacacggaattataaggtttaagctgataaaagcatgggaaaaagattaaatgctgtgtgaatgtctcaaagccttgacatattttttctgtcgatagattcgttaaacgaggtggatttgttgattttttatttttttgcggtataggttaggtttttaatctaccaatgttttgacttatcccactcaatctgtcaaagaacacctgtgaatatgtttttctttttcttttgggatttattggtaattatcatataaatagtctttcatgatttttgtgtttggattgtattagaaatattttaggataagatggatataaaagtgatgataagagaaatataagttttaatttaacattttttagtacattagataacattattgtactatcttgtccttatgtgataaaagttaaatagataatagtggtagtgatgataatgatattattgatgatatcaatttataacaatgttaataataatgatatcagtgtggtgatatcaatctataataatggttataatgacgaaataatgatgataataatgataatagttataataagagtgatagtaatgataatgatgataataaaaattatgatggaaaagtgatagagattatggtaagctagtgataattactggttagaaaaaagatgaaatatgtaaattcatttcaataaattgggttaaaaattctaatcgattttcacaaataacaaaaattgaaaacagattaacaaaagaacctactaaatatacattatattatgttatcttacctgtatgtgtgtatggatatatatcttagagtttaatggttacgtattttcgaaaaaaattggacacgggtcctctcacgttgaaaaaatctggagtgtcaattgaagaaatatacattgttgatcaaaatgagtggacaggatctgttcatacaaaacttagttctcaactgctgtactactttctttgacgcagaaagagaaaagtaaaacattcatttactaaaaaaagtattatattttcaataaaaaagttcttaaaaatacctctaacttatattcaaatagattttatatatttattcattaaaaagaaattacttatttctctgatcgcacgaacaagatgtccatgtctaggtcatggtgcttattcgagccctctaagcatatgaacatgtcatagcatatgaacattgtgatattaagaatataaattttctattttatataaaagagttttaattctatttttttacgtttcataatgtttagtaaataatttaaattttctacccgtcagcatgtgcacactaaaaagaaggagaaaaaaaaatcttgaccagcagatttaagaatagaaatctgtactatgcgcgatggtccgaatggttattggtcgataacaattaataaagctgttccattccacaagtgccaccaaaatcattgggatattaagaattcaggcgagaaggggatcaagaacaaagaagaataatagaagtatcaaaatgtatggaaatggaaggagaaatgaaggtatgggtttgaatcctagcttccctatgttactgttatttcatatcatgaagggtccctctccccagtgttgtacctattcaccatcctaccccttcaacccaccactgtcctcccaacaggtgtcactgccttcttcatcacttgggtcaccaactccaaactcctcctcttcactttctctcctttgcatgcctcccaaatagactcaccccaaaaacaaaacccatcaaaatcaaaattaaaatttcatttcattatttttccaatcaaggccttgctttttggtctctcactcataggccttaaagaccactacaaacaaaaacttcaccctacaattattttgggcatatattgcaccctcatgtatcttttaatggatgttgttttgggactatgcaacattgtggtcaatgcttgcatttgggattgagcttcaattgccgtcagatgacccttatttgtcaatttctttgcgtgatttcttggggagaaggtggaacctcattgtaacatataccctgcgtcacaccgtatacaatcccgtgaaatcattattgatgtccaataccatgttgggcccccagtgggcctcggtgtcggcagtcatgatctgctttttacatcatttaaatttctaatacactatttcataacagtggaataccaaaattatctttggcattttctctcatatgaatctacgtaattcatacggattgacaaatccgtaaaaaccttaacttataagatagtgtaaaactgtttaatattattcttatataaacattaaacacttctattattctcaattattctcaattttacttttccaatttcattgtctcgcgcattaatcagagagcatcacggtgcatcatactatacgcatcatattataccccgtattatttgaaaaagacgtatattatttgtttacagtttcttttttaattttatttttcgacaagtaaacgattgttgctcttcttgcacgttttgcacttactaattttgttttatgtatgaatatttatctatatagaaaaacaagtgaaatatagtcactgcattcttttgttcttagtttattaatttctgtcttacctatgtgatttctttttaatctcgtgacgtgcaggaaaactgacaaatggttaaacttttaagttagaggaattatttagtagtttaatattatcataattttaacttgtcctttttatttatttatttattttttggtcgaccaatattaattgttaaatgttaattttttttgttagtgaagagatttcaacccacaacctcttcttcttttccttccttatctttttttccttttaccactcaaccaatcttatatctcctcaaatgttgatgtcctattcctatatcaaaatacaccacacacattttcttcatttctatttctatattagaaatactgatactaatatctgaaattttaccataatcctatagactatccgtgatagtagtttattttggattcgagatttaattattaattgcttgaaatttcagatattgattaaagaatgtttaatataatactgatatattagatatttttcatttttagtataataaatattttttttctagatttgttggcattttaatgataaggaaagttatatattaacatagagtgcagatcttctaaagtaaaatatttgataaagtaattaaattgttggctagtttaatacttaaactataaacttgaccacaccatatccattctttatatatactatatttattccatttttattgaccttattatttctcctattttactattgttattgagcttttgtgattcaacaatcagtatgtgaatcacttgtaatttgctatataatttataaagggtaacgataattgtgaaatatttgtaaagtgtatttttctcttcaacatgaccgtatcttgctgcttaacaataggagaggattcacattcgatgcaagcattaatcaattgcaaaagaaaacctattcacctcgtgctaatttcggttacagtttactaaataaaaggcttcttttttcatttttttttaccatctgtatgtatgttggctcttatggaaaacattataaccggaaataaataaaaaatccatgtgacgtcacataattcatcacgtttcttataattggtaatgaccatgattgcatgaaaaaatcctctcatcaatttttttttttataatatagtaaaaccgagatataattttcttatttcatcaaaatacttatggaacgaacaagggttgaatacaacaattgtaacaacatgggataatgcccgcaatggaagatgatccaattgaaacgtcattatccaacaagaatacatacagatccagccagagaaaatactgaattatttatgagagctgaaattatctcctctccagcgtctaactagtgattcacattcttaagagttgcatctgtttatacagaaagttattcaccctcactcaagataggtactatgagcggtttcatctgtgctagatatacaatcgcccacctgatatagcaaatgaagaacaaaagtaagcaaaaagaaatggaaaataaaacaggacatggctatttaccagttagaattactattgaaccaaaggaaaatgtaatcacaaattaatgaaccaaagttcgtcaactcaaggcaggcatgtttagaactatgaaaattacatcaccaggagaaataaaatgaacttaattgataaagactataaaagattttggtattcccccttttccaaaaaaataaaataaaaataatgtaattcagcaaagcatgtgctcattccatcaaaaggtcattttccctcctcccttaattatgctggacatactgtcagacagcaaataagtagttatatcagagaaatgataacttttcaagcatttgacttcttgattcagaaactactcacaagttttgatgcatttccacttaacatcactacaattatattacagtcaatttaagcatcaagcacaagccaaagcttcccatcatatatcctttggtctccttgtgaaatatggtggtgaacagtcccatcttaggaccaaagtaaagcaccaaaggcatgggtatgcccaggcatgattgcctaaacagattctgattttgaaaagttcatctattcctcttcaattacttttgtttggtactgttacgcaggacacataataattcaactaaaaggtactccaaattcatgtggcagtatcatggtcatggagagtaaaaggacaggtacacaaacagcttcagcagaactgattatggacacattcagccggagaagttattcatttaggaaataaaatgaaaactttgattttagtgtattccttttccaattaattgaataacagcttgctggggcaacaagctcaggaacaaaacttgtacagtgcagcaattccctattctaactccatgaaaattaaaagaacttgcaaatcaaaggtgtacttacatcatccagcagcatgttgtagcagtaagaaccaaagttaggtgaaatctgcaacaaagtaataagatattagttcatacagagaacaataattttgtgagaggaaacattatcatggaaagagatggatgagacacaacaaaattcaaggaagtcattattgaagaatacaaaaaaactttgacacaaactaaaatataaacataaatacatcaatcacatcacattgtaaaactcatcaaggcgacataacagaatcagctattaattaaatagagcagcatatccacaaagatgtttggcaatatcacaattccttcaataacaaatttttccagatctatgagttatgcgagattatgaatttgttatttgtaatctgtgtaagattagcaacagcaattattaaattagttcataagtcccagaaagaaatgaagaagcaagcatagcatacagattagctgaaggtcctctattgaaacaaattctggtacaaagggacgccacgattccaatcactgcgaaaattagcgtggttacagagaaccccataacggatcctaattcctgtgagacacaaacaaaatttgagaacgtgaaagtgaaaacgaaacgacacaacacaacacaacattacatatttttacattaccccttagttccggtaatgcgtcgtcgtattagtgatctgaagcttcttagcaatttggtttgatttgaattttatcacctcgcatggccactgattgattgaacatgattcattatacctgcacgcatatgggcccatcttattccctcctatcctgttatttgggtttcttgggccacgtttatcagcttttgctattaacactccaccatttactattaaatatattctccttttcttaacaaatattgcaaacgcgtggcaaatgaagtacatcgatcatacattcatactcactcttgtatgtacccaaaaaaagtataacactctcatactacaatgttgcctaaggtggtgctttccaagaaggaagaattgaaattgcacatgaaggtctaaaccaaaacattttccagttaaaaatttaaatttcttgatttaaacttctagatacaaataaatctttaacttactattccaaattttcaagaataaaatctaatgtttcaaaaaaatagtttttactcctacaaaaaattggaagaaagtttttctatctgcatgaatcaaaaaacatctaacttaagtttttaggttttaattttttttattcttaaaaaagattgacatgtattaagaatttacaattcatgaatccttagattctttgattttaaatctcaatttactcttatatattaaaatacagaatttttttataaaatgaaaactttaagtgcattgaatctcaaataagactctgcgtagtttgattttttttattaaaaaaactatatatcaaaaaataatactcagcccgatttattacactagttaagatgttacaatagcatttgacgaaaaaaatgatatgtatgataccaagaacgttaattgacgcattaagagaaaatagattaatagaaatttttaatataaacaattggattcaaattttatatactaataagttttcaataatttcttcaaatactttaaatttgactaaaattttaaaataaaatataaaaataccatcattttaaaacatttaaataaaagaaaatttatagaaaaaatatttcaagacacgtcataacatcaattaaattggtagtgtgtatgtctgtgtttcttttacagcaattaaattgatatagtatgttaataactgatttattagtgattatagattatagatttatttaaattttttttattaatgctttttttactagaattttattattattaatgattaatactctttactttctttcttctttattgtaacatgcgagccaacgagcaagagacaagagtggagcgaaaaacgacgtcgtcgctttccgtaacgatgaactgttaataaacaacgtcccttcatgtgattcgaatccaaccaagtaaacaaaatccactcaaaattggagggtaatcagcttcaatttctttccattttcattttgccctaaaaccctaatttaaaaaaaaaaaaaaaaaaagaccgtgagtgagagagaacaaaaaataaaaatggctatgcttcatcccctcacaaaccgcaacccaaacgagcttctctcactctcatgctcttctatattccaccacaatgcactcacaacttccgtttccttcaactccagaacaacaaaaattgctcctcaatgcctaagtcgtcgtttcgggtcggtgagatgctcctacgcttacgtggataacgccaaaattaaggttgtcggcatcggtggtggcggcaacaatgccgttaatcgcatgatcggaagtggtttgcaggtgggtcaattgggtattgtctttgccacccaatttggaacatcgataattggttattatcaatatcattttttttcaatgctttctatttgtagtgactccaatgctttacttcttgtgtttggaggttataccactttaaaatagttattgttgaagtaaaatagttattagaaattagaatgacagttctatttactcttcttcttttttatcttgattgcacattttagattcacttatttaatccaatgttaatttttagccagcggcgttattctctaagataccatttgtgtttggacaaaacttagatgtaattatttaggagattttgtccagttagaattagagtttcacctcgatagtttgcataataaatgcttatattcgatgtcggcataggttgccaaggtgaaactccaattctgattggagaacaacacaaaagcacctaaataaatgcatctagtttttcgcctttgtgttttgctgccaccaagtgaataatgcagatgttattgttgaattctgcggcattttcttttcaatcagggtgtagacttctatgcgataaatactgatgctcaggcactattaaattctgctgctgagaaccctattaaaattggagaagttctgactcgtggattaggtcaggcactctacttgcatagtttttactatgatgtgatttgtttttgtggctacagtcttgtttctttgctgaatttgttgacaaattgaggggggtggcctttgattcaaattacctgatagacaagcaggtacgggtgggaatccacttttgggggaacaagctgcggaggaatccagagatgctattgctgatgctcttaaaggatcagatttggtatttataacggctgggatgggtgggggaaccgggtctggtgctgccccagttgtagcccaaatatcaaaagaggcaggctacttgactgtaggtgttgttacctatcccttcagttttgaaggacgtaagagatcattgcaggcaggtgtcctttttctcgttatttgggaatgtgactactgaattagttttgctcttaatttaatactaccttctttttttaatatgttgaaaaatatcacttatcttcttcctttgcagtttattttattctggttaaaagtgtgtttggaaattcatcttttgacattgtgttgaaatgaatggattttccaaacacaccatatagtttgttatccaagttatgtgtcatccagtatatataatttgttgtctgaaatttattttatctagcagataagagtctatggttcatctgaaacttgtattttgtcgtttgaaatctagaaaataagtctctagtttgcatttggttttcttcaggcctttgaagccatcgaaaggctgcagaaaaatgttgacacacttatagtgattccaaatgaccgtctgcttgatatagctgatgagcagatgcctcttcaggatgctttccgtcttgctgatgatgttctacggcaaggagtacagggaatatcagacattataacagtgagttgattggcaaactatgtattcatatttttttattcagacactagaacatgatttaagttccttgctgatcccataagatcagctacttgcaaggagaaaagggaaacataaaaagcttgaactattctccccctacttgttccttagtgcttttgagtggtcactggctcacttctccttcataattgggcattgtggctttgcatttatgtctgggtatgtccatgcattttttttctggacattataaactggtgtgccttcttgcaggtacctggacttgtcaatgtggattttgctgatgtaaaagctgtgatgaaagactctgggactgcaatgcttggagtaggtgtttcatcaggtaaaaaccgagcagaagaagcagcagaacaggctactttggctcctttaattggatcatctattcagtcagctactggggtagtgtataatattactggaggaaaggacataaccctgcaggaagtgaacagggtttctcaggtatttaaagattgtcaccacttgcttaagaaacattttgttattcctttgatcttgtgaatttgttgcaaactaaccttataatgtttcttgattttgtgtttatgatttcaagtatagtgctgcagttttttgttatggttatatttttgcattcattttaccttaacatgttaaaaaagttatttattcctctggaattcatctagtcaagaatttcggatagctacccaacctttcactggaagagaaaaaaaaggaaaatatcaatatttccctcaggggtctgtttttcttttcagtttgtgctgtattccgccttttgctgtatggtggtatacgtaccgggttcactcctaccttttcttcgtatttgccttgtccttaacacgtgtaatttttataggtggtgactagtttggctgatccttctgctaatattatatttggggctgttgttgatgatcgctacactggggagattcacgtgactatcattgcaactggcttctcacagtcttttcagaagaagttgctaacagatccaagggctgcaaagctgcttgacaaagtggctgagggccaagaaagcagggccgtccctcctccccccaagtcctcaaacaaggttgaatctagaccatccccacggaagctctttttttagtttcatggttcttttacccttttcatttttccaattattatattgtagtcattctgtagtacaatgatcttgatgcttaatttagtgggatatcattctcttgatgttctttcttcttttcaaatttaaaagcgttagtttgagaatatgttgtgattttattttcacttttaagtacaaaataattaccttattttcattttattttgtttattcaagagtgataggaactgaactagatttaaaagaagaaagaatgaatctttatttgaatattggagaatatatcctgcaatacaatagtgaattcgaggttcaccactctcctaatactttctggattccctttcttcaatcactcacctcctatttatctatttgtgaccctcccacatttagtataactaactaactaaatgtattttactaattgaccctcctgttatacattttgccccacctcctactcctatcagatttgcataacaagttgtaataaaaaacttttttaccattttctagacattctttaaagagtttaatatctatgcaccgaatcaccgtttaaattactttaaaataattattttaaaagttaacaaatttatcatatatgatagattgtgattgaatgattgtgtaaaattttttaccccgtcactatataacccttttttcttatttaaaacatgaaacaaagaaattataatgacatttttgtaattacaaatgaaaggaaaataaaaacaaaatatatccttgaatcgtttttgctagattaagataacaatgaattataaattgaattgaatatgaatatcctcttgttccctcttaccttaggatttcccttcttcccatggaaaaaaacgagggaaggttataattaagtgatattacatcatgatcaagcattgaggaattcttatagttaatgtgtgaagatctgacaatagaatgcatttaaatgtcatctaaggataaagtgataaagttattatttttataagaaaaacgttatattgattctttgaattatcaatgattctttgaatgatcaatgcatttgagaaggataatctagaaaccattacaaataaagttttgaatagctggaaaaaaaatattaaaaacaaaacaaaaaattcaagttaaataataagattaaaggagtagagtaacctgtaggatttatttattgaatttttcgaaattacatcatcaaagaaaaaattgcttaaattgtgtaaaaagaaagggaaaaaatgaaatgttatgatgggatttaagaaatttaacttaagtacctcgttgtggttgcacattaaagtttttattttattttttataactgggttgcacattaaagttgcacgatattaatgcaaatcacgtacataatacttgagcacaatctcacggagaaatgtgtgaaaactcaaccacattgatactccagccagtagcattcactttcatatttgtacaagagaaaaacacacgatatataaaacacctaaatatggcaattacaatacaatacatcgcctttcacgacctcaacaaattccattccattggaaaagtaccaagagaaatcaggaaacctggttatgattctttagtgcacacggcagaaacaaagatgaaaagcagactcttgccaagtttgggtattttattcattacaaatatttgaccaacagccaaatgacaacaaccaaagccactataccaaccactgataaaagcatgcacatgcaggagcaaccacccttggctcgcttatttaaaaccgctaagttcttctgcacccgctgttttcacaacagaaacataaaagataagcagcaagtaaatgtcaataatattaacataatttaaccttgatatgacttaacaagagatttggccccaatgaagtttacgataagagtgttaccctaagccgagaatctgtgacatctacatgttggtctaagtcatcctggcagacaaagacaaaaagaaaagattcagttttagaagggaaacaacaaaccactagctgaggttggctacatagattacacaacatcattcagctcggatcaaaaccaaagattcaggaagaacaaaaattaatgcacaaagggaacatacaattagtctagtgtgtagattcagctcttcattcactgccaatgcaatatgttttgtgcttgccacagtctcttccaattgctcaaagccatcatcttgttctgcttgaatagcaatgcactatcagatccaaagaacagattaaaagcaatatattttcaaacaatccaatcaactgacctttcataatttgccgttgaagtccaacaagtccattgttgtccaggtcaaccgttctggtaattgcatctggttttctttctggcccaaacaaactatccctatttgcaaagtttgacatgttcaacgtggaagccatctgattaacttttgatctcaaatttgaaagcatgtccttgcgacgattcatctccttctcagatctgcgtcaagtcagcaaaatacacttcataaaacaatagtgcaaacttcatcatacaccttcacagctgaattgaaaacattgcctcttctattttaaaccacgtagcttaataaacagcatgacctttttcaatcagcataatcaacaattacacactcacatgggctgcttgctgggaagatttgacaaaagggactgcaagctatcaagcctggtccccaatattgtaatctttctccttatagcagatgaaagacgctgggtttctggtccagatgcaggaaatgaactctgctcagaaatcatgccactgatatcatcagcaagtttcagtgcttcattatattccttcacccatgagtctgaagaagatgccattgacctgaaagaaagaaaaaagtgagagaaaaaaaataaaaacaaacaaatatgatgtttacatcggagaaatgaagaaatagcacaacaattaacaggtggaaaaaacttggatgcggttgtttaggtactttcggtgttattttccaatcataatttaagttttaccatagaaatcataaagcacatgttaccaagctgaaactctaattttaatagaaaaacaccggaagcatctaaagaattgcccggtaataaataaactagaaaggcctagaaatcttcaaaacggtatgggacatgattatcacaagataaattctatttgcttagtacaacccaacccatacacaaatttaccagtacccttgttcaaattaaactacttatctcaacaaagcttttctccatttaaaccagaattgctgttaacagcgagtacgaaaaaggaattgctggtaattactaatttactacaacaattcaagtatgaaagaacagcatgaagaacccttaaaactcatgatcgcacagggtaataataaaccatggagtcatcacgagatgctgatatctttaacatgagctaatttcacaatcagacatacacaaaacgcacaattcaaagaaaagaagaagcagagtgcagttcagaaggagaattgtgttgataaccgaaagtgatcggaattagagtaaagaggggaaacgatcggataagaaattaccctcttttttgggaagctaccactgctgtgactgtgaggaagagaaaaggggtgatggatgcgacgtcgttttaggaaggtgccgatggcgatggatgggatgaggcgtacggcgccacccaccaatcgtcaccgtcgtttacctcacgggattgcggaagatgaaaggtttcgaataattcattcaccacgacgtcgttttaaggtgtcattttcgcgagcattttctctatcttaggaactaggaacacataaaaaaaaaattaaaaataaatgtaactttttctggagttcatgtttgagtgttttatttatttattttggaaatttaaatttaaaaaaaataattttttaagttttagaaaatgaatatttaattttaatttatcacgtttaaatatattttaaatttatgatcataattatgataactacttattcaacatcattatcattatcattatcattccttcacttatttattcatctaactcacttaatatctttttattaattaatatgcatagcagcagtattacgcagaagagaaatgtaaaaaagaaaaagaacagttgtagatttttaggttttacagggtagaatacttttgggacttgggaggcttttgtaagggtggggatctattgatcttgaacacattttatctgtgtcaagtatgtcttctaataaaatgtttagcatttaaaagaaaacaattgttggataatgtatgaatgtattaaaagatgttatgattttaatttgttggttgaattaataatataattgaacttgtcaaattcaaagatatcaccagaaggagtccatattgcaacaagttgatgcatgcacaacaattgagtccccttgacggacaggaagattagttggtttccattccactaagggtaggcaaagttgtccgaaattgtctctcgggcacataccatacccgaagcctccttgttcatcaaagatagatgaatttgaatataagttaaaagtgtttttgagaatttttctactaaaaatataatatctttttcaataaaaaaatctttcaaaaatacttctgatttgtatccaatcaggctcttagttcctcttttgccagagtatgctctcgattttcaactactttcttccgatcatcgcctgtccacaatctgcctcgatcgaggtttccatcacatcctatattcactgtttttcattccatccttgccagatgctccaaacaatcatcgcaaaatcttcaacctctgatgcttttctagcttcatcattattgagaacgcaccctcatattaacattagtactctgattccttatatccaccaaaattaatcataacattaggtccaaaattccacaaaaatacatgcatcaagaagttcaaattataaattcatcttaatacaaggcaatcaatctcagtttcaaacacatttacaagatttctcttcataaacacaactttaaattattccgcctatgtccaataagtaaaaaaacataataaaaagaaatattattcaatctcatgaataaaacttacaaaaaataaaaatggtcaattacaaatattcaatgatcacttgtctttaaaataaatgttttttaaaataggttactagcactcattaattattttttccctatgataatagtgtaaaatattattgattttgttgatgactatgttatattaataaatcttatttatcacctttattagaacctctttattcaatcacaattttatctacaagacttaaatacattgcttaagtggtacaagttaaattttactcataccaaccacattttagttaatcactatgttctttgataaacaagtgcatgacttagactttttctataaaaaaattcacaagatgataattttgtcagattttctctctctctctctctctctctcttaactgtaggctcaaagccaaatttttatcaatttcattattaaaatatcaagtaattaatattgtatttgatatgataaatatgtgaaatacagtaacatcacaaagtaaattttcttaggcatgtttggatgatttttagttattagtttcaatttttttaaaaagaaatgaccaatttttatttttaggttttttcctcaaaatttaaattttaaaataaattcattttgaaagttttatatcctattaatattaatttaagattgattttatgtgataacggtaacattaatgatgataataatagtagcggtggtcatgttgatgtcaatgacaatgatgaagacattgatccatagtaacaataatattagtaatgacgatgacacaacaacactgatggtgatgatggcggcacaatgaaaataaccattatcaaatgtagagaatgtgtgattttttaaaattaaaatccacaaattattttttgttttgttttgaaaataaagatgagtaaagatatcaatttcatttttaccaagcatttttgttttaaaaatcatatttaaaaaccaaaattaaaaaaacacaccacaccgaagagtcttaattatttctgtgattaaatttctgtgtgtaaaccttgacgtcgcatatatattatagactgttaaacgtttaatatttgtaaactttaattgacatgctatttctcaagttcttcaaaattacatgctggtgtctttgcatgccattttcttatttttcttttctttaaagttactactatcaaatacacacacgtgtgtattgagatacgatttcctcaccacttaaaattaccatcaaacacacacacacacagattacacttgttacatatttctaatttcttttgtattttttatatttcttttgtcttttttattgcatcacattaattactcacgtctcttctattttcttctctgaatgcccaagagatgacaccattttctccccatatgtatttgttacttgaactctacggtttgtaccttgtatgcatggaagctaagtagaagaaaggaagagtttctatttggaactatatacacacttggaaagtagttatatttttcttgtgggtgttttctgattttctcattgatgtgcatggtcaagtcattaattagttccgtatggttctttagctaagctgcaacttgagggtttaatctaataaagacttgagcaattttttattaatatataagtacgaatgatatagaacttaagattttagtgtatattttatgatctttttttattactgcaacttaaactattaatcattatttatgttcttcattcaattatcaaaagaaaaattcaatcattgtgtcattatatatgctcgtgtaaaagttgctataaaggttggatatacatttgatagtattgtcattttctttatactaatgcttatacagcgagaagggcatgtcgacagacaaaatacctgtatatagttctattattttagtgagcttattttatttcaatgtattggtaactttgtcttattattttagtgttactcatccataagaaattcaaattttattagactcgatttcaattaatttggtatctttttcaaatcatggatacaagctaagtacaggctatgtaataaggtttgtaattcacttcatctctcatcttattgatttggtttaaataattccaaacaattcggaagtgttttttttttttttttttttttttttttttttttttattgacgacttcgtagttgtgatgttaatatttttttaccacatcaattaataatattttccctgattaatagaaaaataatttgagtttaactgtcatgtattatcagtataatttttacactattatataattaataaaaaccaatatattttatttttacactattctataattaaaaaatcaatatatcttttaacgtaattattttaagatcaaacttagcatatataataatacgtaattgaatgacaatttttttacactttcagtgtattataataactgcattcttaatattattgaataatttgtataatcttaatattgtccactaacttttttagactaccaaagtaattcttttagtaatataataataatatgattttaagggataataataatatgattaaaaatctatttgtatgagaattttagtcaatttgttgtcaaattaaataattttattgtgatatatctacatttcttagttttttttattaaaacttcaaataattgtttgatatatcatgttttcaaagtgtgtttgtttgcgcttcctttacatgcctttttcttaatttcacatcaaaatacattaaaaaaaacatgaaaactactatctggggtgactctggtatggatcatatataattgtgataaaaattatggtgattgtgaaacaacattaaattacttcaatttttttacaggtctcatcacgataatggttgttcattgtggttttactatcaaaccaaacaccatttatattaaacatcagacttagacgtacttaagacctactaatgcctaaccaaacactcagctatcaacatttgattcttggttgcattttaaaaattattgacagctgctttttcaatttctagttgcatgtgtgtaaaaagaaatcaagtttttttttttattgtcaattattttgattagaaatacagtttcgaacaatgactttaataacctaaacatttattaattattacatcaaattttataaatattggtttaccttatttcaaatatttatgatttattttaaaaaagatattataaagttatatttttttttactgtaatagaaagaaaatattatcgaaatggtgcgatatgactagcgtcattaggaattcaatttcatgttacgaaagaatatttgttaagaaatatagtaaagacactagtcctaattcttggtcataaattgatattttttaagtagagagattaatcttgatttgtggccgagagatatgcaaataaaaacaaaaaaggtagagagggaactaaaaagagtataatatctgatgcagaactctattaaaaaaaaaaagatgaaaagtgagtaatttggaaatatattagaaaataaagagggtgattgcaaaaagggaaaagattgaagcagtagagaagagaagagagaggagaggggggagaaggggttgcagagagagagagagatgtcatcttcagacctggacaggcaaatagagcagttgaagaggtgtgagcctcttaaggagtctgaagtgaaggcgctttgccttaaagccatggaaatccttgtcgaagagagcaacgttcagagggtcgacgcccctgtcaccgttcgtcactcttttccctttttcctctttctgggtttcgatttacttatgatttcagctcacgtactaaacaaaattacctcgttggattttagttcaatacgattagttagttgataactactttacttgggacttcaatctatatagggcttgttataaatgtcatatatagtgatgagagaaagcttaagtgtcattctttcgaggggatttggtgttttttgtgtctctttattttgacctatttacataaaaaaaacgttgttttgtgctttgttctgtgtccagagtgtcatgggggcacacaaaaagttttttttttcttttattttttttctattactgtgcatttggggtctactctgctgtgttcattcttctttatgatcctgcttctggtttttgttgtgttcaactgattagttttgttggttgtcttggtctttgtgtagatatgtggtgatattcacggtcagttttatgacatgaaggagcttttcaaagtaggaggggattgccccaaaactaactacttgtttctgggggattttgttgatagagggttttactcggttgaaacgtttctgcttctgctcgctcttaaggtgataatttattcttcttctcttataaaactgcaagttagaagcatcttctgtggtttatgtgtttattttatgcttttttttctgtatgttagatctgttttgggtgccttttgacaatttaaaaaaacgtcccagtcagtttaatctatgattatcacagaaatgtggttggtcttcgatccatgggcttggtggtcactgcatttattgtctttgtgttaactttttaatttttttttcttttttgggaacacattttgctactgttggaatgaaattctacaagttttttctatgggatagtgtgagtaatgtaaggatgctttgttattggtgatgctttattaatctggtctggtactaaggttttgtcagtaaaaagtagaataaaattttgaaatttttgcttttggctgttgtttggtggatttgaatacactgaaatttactcagcagttttgtcctttcaatctcgtcagacatgattttatttgcttgctctagggactcgtttgtttataatatgaaggactactctttccttttgagcttatgttattttgtctatgctgttttctttaatctattttctgagaggatgcactgtcctcattctttctactttgtctcttgatgaattctttttcttatcatttttctaaaggaactaaagaagaaaaacaaaagataattttattttttttacttttgactactaggttctgtcagatgttgaactactcattctttttgtgctcttaatgatgcttctttcattttattcgttattgttgtaactaattaatgacatacaatcaggtgaggtatccggatcggataacactcattaggggaaaccatgaaagccgtcagatcacccaggttagtctatcagctaaattagaaaaaagaaataaatcctttttgtaaacatgatgaagaaaagtgggaaagacactaaaaattttcccaacattttatgactccagattacttattcaatatccatcacttgacaggtatatggattctatgatgaatgccttagaaaatacggttcagtcaatgtctggagatattgtactgaaatattcgactatttaaggtttgctaatatctgatagatcaccagatttgagtattgcattgggagctacttctccttaaggatgctttatgtcgcttgtctttgtttattttgaaagggaaaaaagtttgagagggtgcttttaaaatccattgattggttattttgacaaccttgtctaataaatgtatagactgaaaatgctagcaaatatttaatactcttttctcaaaactctttccattattaagtaaattccgtgtattatataatgggattcaattcaataataaagagagcagtattgtcaatcttacctgtaggatcgtatgatctacttgtgtggctattctgtgctcttgattagatgtagaattgtatgagaatgggattacagtgccaggtcacgagcttgtggaatgatctatcctcaacgagttgcagagtgtgccgtgaaattgtgggttaggttttatgaactggtggggaaaagattatatatttgccctaatctctcccctttttcttcaagtgacactccaatcaagcgatctccctctattcgaacttgtctctgccatctattctctatttcaagctcgttttggcttggcttacctgaaattgagaattttccgtgttttctctttttgtgttcgaccttggtaaccatacttatcttcagtctctgttcttgtttggaacccattttgacttgggttggagtgtttctctgttctgatctttgtagtggctagtgattcagtgttgagtggttctgttctccgcatcttgttagagcatttctgatttcaatctgatcgtcttccctgtccttaattttttggcttataaaagtagtgaattgggcttgagactggcttctaagtccagtacactttctggtcccccctcccccgatatcattatcaaatataaaacgagatgcattattactaataaagcaattactacaaaataaatatccgaattgttatctaagtcttgtggtattattacgcgtcttaattaattacattatcatacttttatatttttggtaggattttttaatcctatacaatcacatggtttatgatctttcatcacttctcgatcctagatagaatctctattttaacaacattcaggagtgttgaaaaaagtgttaaaatgcaagtgtttctcgtgcatagaaatagccaaaaattaagagacaagaggtataaatggaaacattctgtgtcaagttgcttgtaagacaacctaactgcatttacagatttaattggtatagcttgactcttccactaatagtgtcctatgtcgataacggcaaactgcagcttgtccgctctaattgaaaacaagattttcagtgttcatggtggtctttctcctgccatttctacactggatcaggtcaggaaatttaccctaatttgtttgtttttgtttagattgtacactagcaatatttttatattatttattgttaatatttagatacgaactattgatcggaagcaagaagtacctcatgatggtgccatgtgtgacctcctatggtcagatcctgaagatattgtggatggctggggtcttagtccccgcggtgctggttacttatttggtggcagtgttgttacttcctttaaccactccaataacattgactatatatgtcgtgcacatcagttggtaatggaaggatataaatggatgttcaataaccagatagttactgtctggtcagctccaaattattgctacaggtacctaatccactaatctattaaaatgatttttcttatttgtgttctatgtttttagtaagacattttcatctttgtcatagatgtggcaatgtagctgcaattctggagttggatggaaatcttaataagcagttccgggtgtttgaagctgctccacaggtttgtaggcaaagtcacctgatatttattgccattatgaattcgtacgcagagtgagctataccatttttctcaaatagtagcaatacgagcttcaatctctctattggtctacttgtcattgacatggtgacgtaacatagaatattctgtttcatatgactttcatgtcaaactcttgagatgctattttcttttgttttgttaagtaaggctttgcattttcatttttttctattcagcattttttttttttttttttttttgattatcttttgcgcatgaggattcgtagcttttttttttagctttttttttgattcgttttctgtaattcatcatatttatgtttttatatattatttctttttgatcaaaaaaaaaaatgtggttaagaatgtgcttttcatgtgaccttgggttcagtactataagaatgtgttttatcccattttgtttacttatcagtttgttttcatttggattgcactatctttgcatgtttaagcaaacaattggtgttccttgttcttcgcgaacatatgatcttggggaaatttaattgtgaaatttgtcaattgattttcagtttttttaattttaatggaatgtaggaatcaagaggaacacctgctaagaaaccagcaccagattactttttatgaagtggatttctttgtttctataatctacatgctcaaattattgtgggagacttgaatcaaggagatgatgatgtctgactcgggaggaatcagtgaaggacaaatcagttctggaggcaggagttctgcatcccatccgtctgcttcaaccatctttagtatcatagcagtattgtgaatttgtatgtgatttgcaatatgttgttattacctttgttcattcaaaagctgtgatggacagagggtttagagggaaaatgacgtttgcatatatgaaaacttgattaggaaggattggattggaatcagggaatattgggaaataactttccaaatatataatctgtggaaaaaacccactggttgagttttgattataaagtttgggccataaaattttgttatcttcaatttatctattacgtgtaaatgtattattgctcaaattttacacctggtggttggtactgaaatattgccatgcctgaatttgaatttgaatttgaaggttcacttgtcaaagaaagggtcctctctctattaaaatttatcggaattgtttctttccatattttataaattttcatgagctttagtgttactaatccacaaaaagaatatgggagcacatcatcaatatttttaattcaagttaattagggtggatgatagatttaaaattaattttgcctatcaaatcttaattaaatttttaatttttaaaattatttttcccttaagttaaacaacttgttttttatttaaattaatttagaaaaaatcttaaaaaatacacaagagaaacatatttttattgtgtgaaagggtagcagtaatttattgagcttttgctgaagtgtaaaatgcttgaagcctgagcagacaagaatgtgtgagaaaacctagaatgcaaagctcatgactatgaaagccaacttaactaaatgatgatttatcccagttcaatcatgcaagaaagtttaactttcattagattacgttgggattggaaatccgagttattgtattttttttagccaaaagtctgagttattaaagtgtgataaaagttgagtaatattttaaaaataaataaaaaattaaaatatgattttggtttatctattttatttaatatgcaattttgatcatatattttaaaatcgagatattaaaattttctattttagaaaatttataattttggtaaaattttcaattttatttatgttttgtttattttattacaattaattgaactataaacttaatatatttatttatggtattgtcaaaaataatttaattaatcaaaatataagaaataaaagaaattaatatagacaaaattgaggatttgttcaaaattataaaatttttaaaatagagaatcaaatgtttatatttaaatataaaaaactaaaaatgcgaatttaataaaagaagaaatccaaaattacatttaagctataaataattcgcgcccctctatatgaggtgcatgtgtattttcaattattggttgttatatcctcttattttatcttgttacggtaagctttaaatctcttttatattttcaagacattaaatgtatttagtttttattcaatacttaccgtataaagtagcatgatgatagagtagaaggatacaacattaatttaaggcaaaaatataaaacattttttatttacttagttgagttgtatgtacttgtacaagagtaaagttaaaccatgtaggttcaagaatgggaatattgtaaaataatgcattttcaaaagttaaaaactagaacatttaaatatatttttgttgttataagttagtggttttttatttttggttctttctatttttttttttaaattttagtttctgcaaattaatatttttttaattatgatctatgtaagatatgttatttatttatagttcatgtaagcatgaatttataggaattataaataaaaaattaaaatcttaaagtgattaaaattaaaaaatgtaaatttataaaaattaaaaatgaaaatagaaatttataaagactaaaaatataaaatgacaacttaaaacttaaattataaaaataaactcataagaaacaaaaataaaaaaaatactaacttacaaaatcaaaaacatatttaagtaaaaatgaaaacttacaggtcgcgtgggtctcgagctcacatgtcgttatattaatcaatgatcactactatgccatctccatgttaatttaataatgatttttttaacaaaaatccaaaaccaaccacttcttgctacgtctccattcacagttgctgttcctggtcgttgtttgcaaaaattcagcttcaatccaatacgatataattcattattccacatataaaatagtaagaaaacttgtataactgtttcccttggtatggtatttcatcatatgggtgtgtttaagttttcatctttcactggataaacatgaagaattaaccatgctctagtcaaaacttgttttgctcaagattcaataacttggtctgcttaaagatattggcttgatccctcacacctgcaaaattgaatggcaccctcaatttgttttcttcttctatcccttctgttcctttcatcctccacaagtggtgatgaagagggtttcatctctgtggtcatatctgataaaggccttgattttgccaaggatattctgatagatcaagctgttgcctctattgttcagtctcagctgccacaaattgagaagactgtgcaagtccctcttgttggaaaagccaaagtggttctttctgacatcactatcaatgatatccaagttaattcttcatctgttaatactggagagacaggcattgctcttgtcgtttcaggtgccacagctgacttgagtttgaagtggaggtactctgttagcagttggttagttccaattggaatttcggacagtggaactgctactgtaaaggtatgaacctagaatgttactttcattttatactgcatactataacttttatctttgagtaaatagtttacatactaatagtgtaaagtgttttataaaatttgttgacttttataataactactttaaaaattatattaaccatgatttctgattggttgattgtaaaaattaaactctttatctttttgtaagttacaccgatttgcttggtggcttataatttgctttgttgcattgtgttttaattaagaaagtttgaccttgaactaaataataaatgttttcctgaatttggttatttttataaaaaattagttagcctggttgtactactatggaagctataaggaggttatggttgaaattgcattttcggcgtcttgcaattggagtaagaccaacttgttaaggcataccaattcagtataattgaaactagggaatggagatattaaaaaagaaagaaaaagatgtggtcttgagatggacaataaaagacatgtatttcagtatctgatagccaaaaccctgagtaatgtacttttgtgcaaatattttttttttatacctgtttagtcaattatattcctcattctatagtgctgtgctatgttggaaggttaatgatttgcaagtgggacttactgtgaatttaaggaaccaagaaggaactcttaagttgattctcctggattctggatgtcatgttagagatttatctataaagttgcatggcggagcagcttggctttaccaagtgtaaggaaccttcttaagccatggtttttgataattaggaattcttacacatgctctatcttagacaattatgttcttttattgctgattaaggcttcacaattccatggggaggcctttggccaacagctatagtcccagatctatgtttcaattttactccaatacttcaatctttagtgtgggacctgaaactgggaggccagataagagtgtttccgttatcttctgcaacaaaaactattctggggaatataaagctatatttctatttttttgcaggctagtagatgcttttgcaggaaatatagcatctgcagttgaagaggcaatttctaagaaaataaatgaggggatatcaactcttgaccttttattgcaatctcttccaaaaacaatcccattggacgaaactgctgctctaaatgtttctttcgtggacaatccagtgctgagtgattctgctattgaattagaaattaatggtttattcacaggaagaaatgaagttttggtacctcaagcttaccgcagaggatcagacctttctgcttcctgtggtgacagttcaccaaagatgataacaatttcattacacgaaagtgttttcaaatccggttccttggtttatttcactgtaagtttctgaagtttttagccttttttttttcattgcttagtccaataaatggagttttctcttttcccccttccacttttcattttaagctatatctgtgatgtataatagcatcatattacttgttgcatttcttccaccgttatatttcaagtgaattgtaatgcattagcttgtttgtttaggctttggcattatctagaatctgcagaagaaacaatttctttgttgttccacagtttgcatgttttcttgcatcatttattcatacatattagtggactgagttctttaatcgtttaggttggtcatggaaccttttgttggaattgctctaaatttggaaaaaagtattacttactgacatcaaatagaccttgtattgcagatgccgattagactttatgtattaattgggctgatgctttatgagaaaaagattaaaatagtagtgctgatgttgattaggctttatgtatttattgggttgctccaattacattttgcacttcaagcttttacgttatcataaactgaaatataattttgatagtttgttgttcttgtgctcaggcagatagtatgcaatggattgttgatgaactccctgatcaggcccttttgaacactgctgaatggaagttccttataccacaattatacaaaaaatatccaaatgacgacatgaatcttaatatctctgtatcttctccaccagatatacaagtgacaaacaaagatatcggtgtcaacattttcatagacataacaattgatgttctggaagatggtgaagtcatacctgttgcatgcatctcggtggtatgctttaataaagtcaatattgaagtagatagtttaaaattttatgaagcttacactgtttaaatagccatccctcataatatactgtgtctgcattctgactaagctatatgaaattcaagctttctaccatttttgtcatcatgttatcgcgcgcgcgcgcacacacacataaccttgtattgatcttctgattaaattttcagatttgcctacttttttttgtccatgcctaagattatactatttcttaaaagttaattattttgtagagtttaaagaggtagccatgacacatgatcattatcttgtttaacaagtccattaatctttgttattggtacaggattttagtgcttcttgtgctgtggaaatcgtaggaaacaatcttgctggttggcttaaattgagaaagttttccacgtacttgaaatggagtaaaatagggaaactgcacatgaatttgattcaggtatattggaataaatgtattcagctttgtattttgatatgaaattgaacaacaaaagccttatcccattagtcagctatatgtattatatgacaccattcggcccagttaaagaccaaaatcttcagagatatcattcgtcatgagatccttttgaacaactttctccaatgtccttcttggtcttctcccctcttcttcataggaataaaaaccatgcaatctactctcctaaccagtgctacttctagtggccttatttgtatggccaaattaccttaactactaattggatgaaatttaacaatacgaacaaataattccttctatttttagggactattctagatcaacccatgagtgttttctgtttcaattagagagaccacagtggtatacaaacttgattcattgtcatgtgaaatgcgaaagtgacacagttgccaaccatttgttaaacatatatgatatattcaaggtgtccggtttatgttttggtctatttccaaaatattacaaatgacaacactgccatagtttgagggaagtggtagacatgcagtatctttttttcctggcaataatttaataagcggataacgtgtaccaaccatcaagaacttttcaacccatttacaacctttagcctttcatatttcactttactgattcattcataaatcaaaattctgcacatggtttagcacatatgtaactccatctcatgtgcacaaccactccatttatattttgacatatatgattgttaaaccttagtgattgtatatcgaggctattatgttgaatcttactctttaactgtgtaaacatttacagtcagtgacatcaaccgtcctcaagaccgttgtcataccatacctaaactcgcagttattgagaggaattccactgccaattcttaatggttttgccattaagagtgctcgtatattgtatgctcccccatggattactgtgtgtagtgatgtttctttctcaggagactactatctcaaacaactaccagcttatgtatcataaacatgctctcagatatctgtctgctttgtgtactaagtggtaataaggtaatgagcaacttatcaagatggctatgaagagtgaatgacatgaacattggtgtagctctggattttacctattgtaaatcatgctgtcctgaagattacatggaaaaactgccaatagtcaaacgtccttattggatttggaatgctctgcaggttctttatttttttaatcagggattggtatttttatatgtaaatttgtgaaaataatatattaacttttgtttggatacatcatacataattaatatttttattttcccaagtattaacaaaaactagttttttaaaataaaaacatttatttcttcactactatccaatgtgcgaaacaactataataacagtaagttggaacatagatacatttttcttttatagaccacgtgtatatttacagaaaacaatcttgttccagcttaataagaaatgcttcttagcatacactttatatttacgatttcatattttgtatggcatcgtagattagatgtcttagcatgtgtgatgtcattgtttgctctggattatctttgatatccaagtgtgtgttaacttagaactccgaaaccttacttttgagtcatgttaaatgcaatctcaaaccagtaagatttttaggtctcaaattctcaaaagaatatacgaataaattttaatttcatctttaaccaactttattagaagtgcattaagaatatctcttttgcctactaattagagatttatcttttttcagaaaatgctagattatatggagatatttgataataaaaaaaatgaatgaacattgagtgcatgaatcatactaacattaccttttaccttatctggaatatctataacttgatttcaatgaaagtaactttaacttgatctcgatcaaagtaacttcagtttaatattaatcaaaatattttcaactcaatgttaatttgagtaatttcattgtccttcgttagaatatttttaacttgtcatcggctagagtattttacatggatggacaaaacaaatcacaaataaatgaattcttttaccacctctaattttgacaaattgagttgtcaagtcaactcgaacgtgtgtccaccttcaactctcgtgataatgtacatgatttagcaagaaaaaggtttatatttggttacataaaaaaaagggggaggtgaatttttaaatttaaggcaaatagagtaggggtagcattaatccacaaggccatgtggaccttttgaccttataggcttttgaccttttaatccattttaatttgtatgaaaaaaaaaaagtttattcatttcaatttgtcttcttttacctctatttatcttaattaaattttaataattttcaaaatgaattactattggtgaaaaaaactttatatctcaattgaaattaattgttatataaatctgaaaacaatttatacatttaaaaatattttatatcttaacatttattctatacgaagtaaaatggtaattaacattatattaaatggtgatctggaaagtggaaactcagtgagtcgcgttacgagttgggtggggaggagttaaaatagaggttactattaattagccaaaagcccttttatttttgtattctgtgggcgtctctctctcctcgctagggatcgctctgatcagccatccaaactcaactcgttctctttctttcaacacaaactcactactcactacctaattacttacacgccttcttccatctcatttctcaaacacacacacttacccgccaaaattttaattaacccttccaattcaaacctctttcttttcctttccctctcttcctctctctctctctctctctctagggtttcccctcccatggaggaggccgtctccgatccccagccggagctggagcagcagcctccgcctcttcagaacggggactccgacgagcgctgcgccaagaaacctaaattcgaccatggcgcagaattgaagagagtggcggagattgtgctggttctctccaccatggccacggtgcgcgcggggaggaagccctccgacgccgaggtcgagctcatgagggaggctcgcgccaaactcgccagcctctgccagggtttggctccgaaggatattgtcgccagggaagctattggcaccgtcattgaggatctcggattgaactccaagctcaaggaccagagattagggtttcgaactcccaagatgtccattgccgagaggtattcccatgctaagtggaaggtaaccaaccctctctctctctgctcaattaacactcaccatgcttttgacttgctcattttgttattcagtgaacatatatgtagaattaaaagaaatatcatctcgttaagcgagctgctcaagttaaaatgtgtgtgttggttgttttgaattatttgttatgataggtgcttgaggaatactattatttctatcgtgattgttgtgaatgtgtccgagttaggaaaatgaggatagcagcgtgtttggatatgcatcccgcgcgtgtaatttagaagcaacgacgtgtggcttctacatttttcttcttctcaatattgacctgaaaacgagcgtaacgtgtgtagtcaatgcattaccaaacatgcactaagaatgtagtgttcctagcactacgaaattcacctgattcttatgcaattgttttgtatgtttttttatggaggaaaaaggaatccttggccagattattgtatactaatgagctttatttacttggcttggctaagctagtattggattatttttcggttaattttgtgttgccactcttattgatcataaactaccttctcgagtgggctttttgttgagtttgttggaatgttgaactctgttaattagagaagtattttatttcttcacgcacaagtaagagcattaatttatttataatatgcatgttatgctaagaatgatgctatgccatttcttttggttagttttttctcctttattttctctttatttactatcatttttggttaacagatggaagaagcaaagaaattttctgcaccttctacaccttctacaactcacacctctcagcccttgcaaacaaacattggtggaccagttgacaatcgtgtgccatcacatgttcgaatttttccttctgataaatcaagccacccatcaatcccttctatgggtgcggtagtgtctattcctggccatgtttctgcaggatcttctgcagcattgcagtatcaagtgatcggcaatgaagtaagaccaccagtggtttctggtgtgatgcctggcagtcacttgggcagaaattcatcttccttagcattgcctaaagttgaacacccgcagttcaaagttgatggaggatcaaatgggtctccttacatgctgcaagtccaaggtattgtcctctgaagctcctcactggatccaatttccaaggactggtggagttacatttatgattgatgaatgattgacagtgcaatatgtttacattgaatgatagaatgtgaattgaacacactgatatggattttattttactgtgaagcaataaaacacataacattaaatgaatgttcagaataaaatgctgtaattttatggatgaatacttacaggttttattcaatgttaaccatggagtgatgcgtgatgaattttgaaagttgactgaattggtgtatatctaggcgaattggtctattgtgaggttattgaatagatataatctcctagcagatgttgctcccttttccttgtctttaaagagtctggaattaaactacattcatttgtcatttttctccttcaatctctgttatttgtatgtaactgtcatggaaagctggcattaaggttttaactatctattggcattttcttctcttttttttttttccagctaaaggtggtagtctattctctattgtatctttataatgtgtatgagtgtatcttatgacattttagtcatgaaattggaactggcaactgaatgttagaactttttaactgtagcaaatttatcagcaaaccaacctttggtgaatgctccaacatggtctatacagactcaagctgcttcattagctagaagtgcatcagaaaacaaggtgcctgttcagaattctgtcaaggttgaaggaacacctgatgtaactgtatcaagggcagggccacaattaacaacagacccgagctttagaccatttatcactcaaacagccactggaactttacctagtgtgcaccagccattgcaggccacaaacatagttcagcctcctttgattcctagtcatactgacattgctaagattgttcagaaagtgttacaaccaaagcttcctgtccatcccacgtggactcctccatcaagggattatatgaataaggctttcacatgtcagatgtgtgagctcagtgtcaatgaggttgatactgtacttctctgtgatgcttgtgaaaagggatttcacttgaagtgcctgcagccatcagtcttgagaggaattcataatagagttgattggcactgtatgaggtgcttgagtttaagtgggggaaagcctttgcctccaaaatatggtcgtgtcatgagatcctcaaacacatctccaaaattgccttctaatacaggaggcattcaaccctgctctgagaagaaagtagagaatgtagatccaaaggccatcccacagacgttagcaacaaatgggagctctgttcaaactgtttgcggtggcaattacaatgttgagttgtcatctgaatcaaagataccagataccaaagatatgcaagggactgacatttcatccaccattgaagctattgataagaagcctgatccaaacaactctatgaaatctcttagtgcagcttctagtccttccccttgtttgataggtgaaaattatgttcaacaaataaattctaaggttttgactggtaaagagacttcggtatctgagtcttttcctaaattatctgagccagctaaatgtgaaaatttgcaatcatcacaagattttcaagttgaacatacaatgtcacaagacaatgctcaagtatcatcagataagcatgttgacagtaatattatgaataataaacagaaggaatttcgtggaggagaaagtttaacttatgatattaagcgtgatgaccaagatgctgcacttgcaaattttgttggaacttctggaactaatactgatggtagacagcactctgcattatcttcagatagttcacatgcggtagaatggattggtgatgtagtacaactagtagatgagaaaaagtattaccaatcttgttgtattgatggagtaacatatggactgcagggttatgctcttttccccaccagccatgggaaactaactccttctaaactccaggcaagcaaatcatcatgctttccaatatagtctagccgtcggttatgtcatacctgtagaaatttatctgaaaaattgtgaagtagatatgaataacaaaaaagttgtttttggtgtactttactgcttctgttttgttttgattgatttgaacccttgtgtggaatgttacttttataaatttatagaacttttaacatagggatttattccatttttattttcagtctatgtgggaagattgcaaaactgggttaaagtgggttaaggtgacaaactgctactttcctgatgatttgccagggaatattggtcatccgtgtatatctgaagtcaacgaggtattttttttttttattacatacagctttatatataaaattataaaaaatagatgtcttttttattagatggatataaatacattcatgcaagtgtggaagtttgtcattggtatgttaactatcagtttttatctaaagctagattggcttacatgcacttatactccataaactgtttattggtttgaacttgtaacctatacagttaatttctattttgtttgatattccaatcaaatgataatgcttcacatcttggacatgctcaccattcagaaccatatatatggatattttcttatacatatgttttctttgttgaaggtttatgaatctaatagtgatagaactgaaatggctaactctattcgagggccatgtgaagtcctctcatctgataaatttaaacaagaaaatgacaggcgatgtcagttaggaattgaggaaacttctaaagtgcagcccattttcctttgcaggtttgtttctttatattcatccatcattctagagagtttttattttgttttgtttttcttcgtgcctgtttcattcaatttatagttttatacaattttcgtatttgtaatgcagccatcaagtagaaaatatgattacaatttatcgcatggtattcttggtagaaaacagggagatgaaacaaatagctgagtatgaaaagggagataaaatgcttttaattatcgtttaggcttgtcattggtggtggaaaattggagattgaaacatattttcatgctgcttgccaatatgactgagcattaagaatatatcatgcttttctattttgatttcaatttgatgaaattttggttcaaaagggaaaaactccgtaatttttagataattaccttaccaggaaaataatgaatacaagaaagcttaattgtcaattgaacctggcagacaatcacaaacaaggactttcatgtatatgatgaaggaaactcccttcattctcacgcaaacccttgtaatcaatcttgcgaccaaccccagatacgctatagtgggtaggatagcacattctggaagccaaagactgaaatgaaagggcaaagaaagaatagcaggccgaactataattgcagtcaccgcagaagagttgtccctgctgagtgagggtggggggcaagagaaaagagaaaatgacgtctttatagaagaggagggtgttagtgtcattgctgttgaattttttttttttttttttgggggggggggggtgggtgttagtttatgtatgacaagggtaattgccatttgcacccttaaccctactcccctaaacaacactactgcaggggcaaaattgggttttgaaacacatcacaattgtgctttaattgcacgtgagaatcttgcaatttggttgtgacagatttgacccccaaaatgccacgcaaggatgtggctgtagtgcccagcggctgctctgcggtgctatggtgtcgtattaattaccttggaaacaggcggaatgtggggaagaaagaagagcagtctgcactgtatttgcagtcgctcggagaagaggtcatctctggtgtgggtgggtgggcaagagaagaggatgtcttttgacaagagaaagaaagaggatggtgttggtgcgttgctgctggggggtagttttttgtttttgttttatgcatgaccagagtaaatgtcattttcacccttaacccaccctcctcctaaacaacactactgcaggagcaaaattgggtttttgaagcccataacaatcgtgctctgattatgcgtgaaaaggttgtgatttggctgtgaccccaaaaatgccatacaacaatgtggccagcgttatcaattgcggattgtggaaaatggcggaaagctaataatctgctatatcatttagcggatagtgtcacaggcaaataacaaaagtcacagtggttgaattatgatatatgcataaaaataagttgcatgcaaataaaaaatatgcctaaaattgacatattataaattcaaaagttcaattggctggagactcaccgaagatgactagaggatacagggttcatgcctcaaccacaactcccatagctgccgcaatagtggatggagtcatgattgtggatccaaagaattccataacgcaaaagcactatagtgctgctgtagtggctatttaacaacactggatgtggctgtaatgcccagtggccattctgctgctattgcactattaattaccttggtaacggcctcttttgataacaacattggttaacctactcatctcggaaaacattacagggctaacaagaccaacataatccatgagtctaatctgagtactttacttcaactggccattaacaaaaagagatacatatgggctaacccaatagatacttcgccatatttggcattcagttagtccaagttttaccaaatacgtggctttgctagtctatttatttatgttctgatgaagttatttcataagcttggaatgcaaataaatgctattctatttcattgctgtttctttgtttcttgcatcattttgtgttttatatgcttaactactggttttgaaatcaaatattgaattcatcgtttaaaggttcataccttcactatccgactaccagtgtagctattataatctactggtatatccacactattattaatcaatctggacaaagtctgaataaatcagagttgatattttggccttttcaatttttcttctttttgtattgacttttgaggtgtctcaagtgatttgacttgttttgcaggtggttttatgatgaattcaagaagttatttcaacctgtaatcagttgattatgtcttgaacgtatatgttttgtgattcttacatggtgcaattttcgtggtgagtatttgacccattacctgtccaaattgtcggctgaaacttatttttacccaatgtatctactgaatatttctatccccttagagcacttgtgcgccttagtaaaatcgtgggaacattgggttgggggttatattcctgaatttgggttgaatttatttctgaagcttagacttgtaaacctgctagtttctactatttcaaaaataataataaaatttatagaatccaaacatgacaatgtgataatcacattcttcatctctatgataaagcaattaaattggaacaacaaacaagggaaaaataattggaaatttgggataacaaattaacaatcatgacaaacaaataggactttcaagtcatttcaagcaaaaattagcctactactgtcttaaaggttttgaacttaacattgaggatattttttaagagaagatacctgaattgaatagaagtgaattcaagcttggaaccgagcaagaacagatgaatatagaggaagcaacaaacatgagcccttttagcttcatggacattaagttgtgaatctacttttcatttatatatttccttcttttctcttatttgcatccacccctaattagtgataaagcctgaaacaatagttaactaggtaaattgaagaatgcataacattttggtgttatagataaacttggacgatgcagttttataatatctggttaccttttttgcctgaaatatgatgcatccacacttaaaccttaataattttgaagacatacatgaagggatgttaaaagcggtatttggtgggtcttgattctctccgtcccagttcctgtgctgatctttgatgtgcttctgtttggatgcaggtatttggtggggtttcgaacaggatatttattgtatgggtaattgagcatgcattaagattcatttgagacccattataaggcacattgcagcaacattgcctcctcgtacaagaatgttctatcatttcagcataaattgcttttgatgtaaaatatgtagctgaatctgtggactgcttagtttagctttcgctttggtagttctttttccgatagatattcattctgtataattcttttttgggcattaggctctttaggcccaataattacattattatctttgaattagatcagtgtagttcccttagtttgctgaattgtaagatacttcatttgtacaaaagccatttcttctaaaatgcataaccttggcaatttcgttatcaatttggcgacacgtgatgatttttctagctatcgccaaggtgtttctagattctgctggctgagctttagtattgggtcatgggttgtttacgggaggtgttttaataaaatatgttcaaatcgtccacttaataataaaatgatattgattgagtcacgtatattcacttctcttttcagacatgaaactactttcttaatgctgaattttgggtgaagaatttgaatcctgctaacttcgcgtccatcattagtcatgaaaaaactcttgcagtggtcgatctcgagattcatttcatttgcactttgtattgtgtgtaatgcaacagggagtttttgtacgacttgacggtacgactactaaatactaatagtattaaacattgttttatcagtcgcatcatcttcgtaaagtaatactcttaactttctcaataaaaaaattctaactcagctctagaattggtttttcgaatgaaagacatgtcttaaattgttcattttggataagattggacaaattacattaggtactatttttttcaaagaaacatactgactggctttgtttatcacatattgttatattagagatatttttatttcattatttgtcacactcttcaataattgtagatgtctatttttatacttaaataaattatactgggtgaatagtatgagttaaatattatactttaattttaacatgtatcagtattagttttattgtggttttatatatttcaaatatattattagtaaatattactcaattgttcattttcattaaataaaaataataacatttaagataaaattgaggcgttagttgaataaaaaaataaaattctaagtaaaatttttcatactctttaacaattatctaacctattttcgtaattgaataaatcacattggtgaatagttcagattagataatacggttgatatattgatcctgtaatgattggcatatttcaaacgtattttaaataaaaattgtccaataattcatcgataaacgtgcaaaataaagacactcaaactttttgtattcctcttgcatcatgcaggtaaaaaaactagttgtgtaaggcgacagggtgtttttgtacaacttgacagtacgactactaaatactaatagtattaaacattgttttatcagtcacttcatctttttacagtaatacttttaaactttcttgaataaaataaaaaatctagctcagctccagaattagtttttcgaatgaaaaacattggtgaaaattatgatgaaaaggtggggggatgcgaatatcaaacagggggtgttgggccatgttctttctgctgaggtttgattcacaaggcccaacaaagatctcttcatgggattcatttgctattacaaatagtacagtataaaatgtgtgtgtgggggggggggggggacgggtattacattttcataaaatattgtttatctcccgcttgatgttcacgaattttaatagggttccgcctatttaatctttatcaagagaaaaatatgacaaatttccatataaaatttttaactaatctttttttttatctaccactctaaaaaagcgttgttagtagtacagtattttcttttatcgatccctataagtagcatccctatctccatttattgatgcgtatttggtggcctaagtttgtgagtatagacaaatagttaacgccttaacggaaatagagacaaaggaattgaagtagcttcgtgatatcaagacgttgactaaagtcttacattggaaaagataaaccatttgcatgagcatcgtgtttgtgaccatttttttttgggtttaaaattaactacatagacataggagtatgattaatctagattgagtcaagtgggactatcatcgcagacgaaaaaaaaattcccctcgaatttaactcgagacgtactccttgattaagttagaaccgagatatatgtatgattagcagcaaagttgcaagtcctgagtttcatgtacatctccttctttcccaatatcattgaattcgagataccatgccgggtcctatatcatggaagaacttcaaattatacactgagttctgaatagcctatcaattttatataactgatatataggcatgtggatgcttacctcaattctggcaattcttcaaagtttagactcgatcgcttaattggagatgaaattctacgctgttagccaatcagcatggcttgatatagaaaaatcaatgcaataaatgtggatatgtagagatatactcctatgtacctaataaatgcccttttgtgaaaggaaaaaaaaaatcatattttacgctcttctttgtcgagacaaaccgctcttaaggtgtattttttgcctgaaaagtttgataccaataactgctatccttgaataattctgggggttgctcctttctagagtgacagatcaatatattttagattagtgttcctttagaatttgcgtgggcataaagctagatgcctataggctagatagagaatatataggaaagacaagttttatttataaattaaaattatatcctagttaaaatttaaaaatatttattatgaatgttataagagaatataaaaaaagttatgtataacacaattttatgtattttaataatttttttttaattttttaatcagtggacattgattaatatttgtcaaatgaaaatgagatataatatatatatatatatatataacaatttttacaccaatttatacataattttatgtttttatctttctctaacatatattatatttcaaaattttctttttcttctcacttttctttttgtaagatttttttttacaaatgtataatttctcaatcaaaattccacaattttttaatatttttttacagataaaattgatgtgaaaaaagagagtcgtgggatgtaataaaaaagagaatactccacgtatacaaattataaccgctgcaagagattatcataactatgtgacatttaaaagaataaattattaaattaatatgccacgtatacatattttaaaggaccaatttaatgtatttatatgataaattctcagagctactagtacgcaagatcaaaagcacacaagctattctattggatttgaaaaattatttatagtaacctaagtcttaagacatataaagagaaagagagggaagtacaagtatgaatataataggttatatgatctgatataaaaggagagatgaagagaaaaaaaaggtattaataaagtgtttgatatatatatatatatatatattaattatattattactcattggatttggacctcaaaagttctccgagcatgtgcttttctacgtaacatgttttctccttttatctttcgtagtggtagtagacaaaaatgatgaaattcatagtggacaaaggaagctagaagaatttgttcataattttagatcaagttgtggttctagctagttaataggtaattaattaaccgtagtggttttgaactaaaataatatgcgcgtagctaaatttacacaaagacattaacgtaccacagaaactaatcttcacttgcaaaaccaaaatatattcctttaaaattatacaaccacactgttgggagaaaagatcttaagctagtaacaaagcacaaattaacatcaaaacacgagtaagcattctcattaaaacttttattctactttattataaggcctcatgcatccacctgtctcaaaagtccaaatctgatgttttgaaccagaagggccacacacaagaaaaactaggcaacgaaccgttgcacaagcatatatgcaaaagggaaataactactaacttacttttgaccatcccaccgtatctttgacatctctcttagggctaaaagtctcccattctctttggttgaatgacctagcttattaagttactaaaggtagcctacacaaacgtaattattttggtttcaccaaaaatatgagtagtgataattcctaatccactaatctaaatagatgttgaataaaaagaataatgaatgcgaaaaggataaattataaatatagttcttgtatttgacattatttgttttaatctctatatgaaaaaaaatctatattttgatattcatatgaaaaattatttatatacaaagtaatatctaatgtttattaaagttataactttgttagaaattcctacattttttatcttgaattgagacatgtcatacatgcaagcacacatatgtcaagtttttttttcatgtagaaactaaaacaaaataaatgatgtagagtagggactaaaatataaattttttcatataggatttttttttaatgtagagaataaaataaaaaatagtatcaaatatagggatcaaatctataccattataactttggcaaataatatataggtatcaattcatatgaattaatgtttttctatataaatatgaaaatgtataatttcttctataggaattaaattaaagtattacatgtaaaaaaactaaaacttcaatttatccaaatgaatatgaaccaattgattttaattaagttttagggtgtgtttgaattggcgtgagttatgtccaacactactgatcctttgtgagagagtatatatcagtgctccctgttgaacatgtatcaaaatgcgggattaaggtaaaacaaacccacaattaagagatataagtagatgctagattattataatgttcatacaatgacaattaaaatatgcaggagataatcaaatatgctaaatataatataaaatgtataaagtggtcggcattgtttcacgtaaatggcgactatcacggtggtttggatttggactttgaagaaggagctcaaaaagaaggagggggccattagctagccagatgacaaagattccaagtttttggattccagtgtaaattaaatttcagaggatagaattaagtgtcatatatatatgatgcctttttcacaaccttttgggttatgcaaggctctatttctatgtcttgtgtgtgctttttagtaggaattgaaaatatatatcagagaatttataattgagttatattctcgagatatatatatatagacgcacaaagaaaaatagattgagagaatcaaaatcacatcatttatttgcgccgttcagatttgaactgtggaagttaatcctctcttttcttgttcttaaatataatatagttttgtgtcaaaccctacgaaactgttaaaataagtatacattgtgggccaatatataactgatacagttagttaattacaatttttaggtatcatttaaaattcagattgcgtaattttacatgcacttctaggatcattcaacctagatatgaaattaagcctcagagcatactcctatatatatagtccaaaaattaatgaaattataaaaacaaagttcttacgtttccttgcattagatggaattgtacacggaggaaaaactttcaaaaaccagttgatggcaatgcctgtattttttcttttaatttttgtgacgaattataatatagtggtagtgaaaaatacagataaatttctcaaacctagctatatgacatctctgaagccccacccccactctcgatcggtctctttatatatttcgtaatctacgattttgactcctataatgaagaatccgaggatagatatgcatggccttttcaacagtttttttttttttttacttatttatttaattttcttatatatgtggtgaaattacgtttcttaattacaactttaattttaacttaatataaaaaaaagtgtaacttttaagaagattattataatttttattttactcacgacttaataagcttttttattttattttataaaaatggttttgataaagtcataattaaacactaaacacaacttatatgaaaacattgatgtgatctactcacaactttttaatgcaattttttttatgataaatggagaagccatggatcaaagacaaacgttacccctagctaattaattcatgatttgaccatgatttcattatcacaacttaattcgtggttaggcaccatgattttcatttaaattaatttgttgcctatcgcatgagtttcccttgaccgcttggtataaaaatgaaatcatgcatggtaatggagttgtggctaaaaacaccgttaacccttaaatttatataaagaaagtaatggttcgatgaatttattttaaaagaatcgtttactaaattgtaggtatataagtaatatattgcatattggtaaaataaatttaaattccaccaaattctctaaaaaagataaaaaaaaattatggcataggtgtgacaactaaacataattaaggggttccttttgaacgacattcaggattctgtatacctgttgagacatatatgtgtgctgtccaagctgagaaagaatattactgcatcatccttcttgttgacatatctatctcttcatattagctagctaggttctgttattgatcagttttatattaactttgacaattttttattttattttgtttcactaaatgtcttatagttttattcgattattttcatattttttgaagtttgagatggtatgtgtacatgcatgtacttatatagtaaatatttttttagctatatcaatatatcaacatcacttttaacttaagttaattgatattgatgatagataataaatttatttgtataatataaagttgataataaccttttaaatatttaaatgtaagactatgtatttggatattttttctaatcacatttttctcattcacaaaattcaaatttaaaattttactttagagaattcagttcaatgttacttaaactaatgacatattggtatgagactataatttaatttattgctttatatatgtatgagccaagtatttttttaactaatatttgaagtctaattttttcaaagataaaagttaaaatgaataatttgtgcaactgtcattcaattactaattattatatgtgataagtttattttttttaaaatcttaatagtcatactaataataatttatgtttggttgatctacaatgtagtgtaaaattcttgctgatattatataaaaattaaattctaaagattagcaaactaattttatctctctcaataaaatattttatacttactaaaaccaaagtgcaagtatttttttttaaattcacaaaaatattaaaagtggaagactggtcaataatatatatgtttaaggtattaaattatgtctgtgaatattatgttagacttattaacaatatgattaatcgatgtttctttatcgtgctattttttaggaaaaactaaataaagcagtaactaattaataaacaaaagaaagcgataaaaactcaattgattaatctttctaaaaccaggtcatgaagctgaagaatttgtcatttattttaacatatatggaaatccatttgcaatttgaacactttttaccctttcttttgaccgataaaactctagaacgattacttctctcaactgtttttgaacgtcttcattatacgagagaacacggtttcatattaagatgtaaatgaacttaattgaccatatgtaaaaaaagaattaacaatatatgacatgcaatgcatgctattgctgaattaatttgtagttgtgaagcaactgaatttttggggcatctgccttggagtaaatgtttatggtagcttgaagttgattataacttaattgattaccttttacatcccagaaaagaaataccattccatttaatgaattcgttttggtaggtactaactgatgaaccttgatttctggggtgatgacttaattaataatgaaataattaatcatcatttggcttttaatggattactttgactctccttatattataataaagccctaaacagccgacaaaagtaatcaatctcctcacaagaataaaatttataaaaaattgtaaaagttgcttagtaaagagtaatcaatttaagttgctatttacatggcaaactttgggcaaatgaaaggaaacttacgtagccttaggaaccattattatcaccttctttgtttttcaccatataggtagctagttaattgattccttaaaatacgtatcattactcaataatctaacattatattttaatctaaactgcttaattagctgtatcattatgcatcgagaaatgtttttttatatatatatagagtgaaaaaggccatgatggaaaactttgcatagcacttactgtcttatgatttagtacttttttttgcagataatataaccgatatggcattctgatatcaaatatatagggattaattaatgcaataagatatctgtatcatttatacacactataataaactttaattcagaatatagatcgtctgctcacagtaaacttcatagctcataaactttagtgtttgtgtgtgattaagatccttctacctatttaataaaataatccttctaccattaaaaatagctatagatgatcgaaacattaatcttttgtcgaatcttagacatattctctataacagaattggtataattagttgttacaacaagcgaatacaatattatttctctaacaaaatatatactgtttttttggttttagtcagaaacaaaatcgatatttctatgtagcttatatgaatacaaagatccggcgccagtttgggccttccatgttgcacacgaggcccacactttagcttttaacttttttttcaagtttctttttagtatcattatttttcttttcccattgtgtagtatagttatctattttttttttttatataatgataacaacaacaaaaataataatgcccggttgcttaacataatacatagaagaaaaaaaagaaaaaagtagctagctagcccccccttctctgtctatatatatcacctctagcctcttgagttttccaaactctcaaacctccaaatactctttctcttgtctttatttttcatatacaacaatttccctttcattcattcattcatccatctcacagctattggggatcatatatatatatatatatatatatggctccaatgggagacaatgttgttgtatccaatatggaactggagaagttgcttagcatgaaaggaggtaaaggagaagccagctatgccaacaattcccaagcacaggtaccatatatatatatatatatatatatatatatatatatatatatatatatatcatatgtttgttggttacaaaaactaattttttttatttatctgacaaacgctacgtcttaatttactaagaaaaactaaattcagtagataaaacatgcatatgtgatatttttccttaatgatcgaatccaccttatatattgcaggccatacatgcgaggtccatgcttcatcttctgagagagacactagacagagttgaggttgttgagggacgtgaggtggcatttgtggtggcggacttggggtgttcgtgtgggagcaacaccataaacgtggtggatgtgataataaagcacatgatgaaaaggtacgaggcattggggtggcagccaccagagttctcggctttcttctcagaccttcccagcaatgacttcaacacgctcttccacctccttcctccgctcgccaactacgccgttagcatggaggaatgcctcgctgccaacaaccaccgctcctacttcgccgccggagttcctggttccttctaccggaggctttttccggcaaggtccgttgatgtttttcactcagccttctctttgcactggctatctcaggtaaccaacacttaatttattagtacatactattttaggatttttttttttcaagaaataagttataatgtatttttcataaaataaaagtaaaaataatatctctcttcttattagaatatattacactgatcatgatatcccctcttatttcttccaaattcacaagatacttcttttgtctttaatttttccagggttacgtacctttattatttatttaaaatatattacactatcatttttgttatactaaagaaaacacattataccattgatatatatatcctgtaacttgtaagggggttatgtaaaatttaaaagacagggtagtatttcaaagaatggtgtaatttactcttatctctttttatacttttttttaattgttaatatcaactctgacttttggtttgtgattttgttttttcatgttttcaataaacagttgtcaaattgtcacttcatttaaattttctttcttatttttaaatattttattttgtatagagaataacaaacataataaaattgtcttgtataaatacttaaaattaaaaataaagtgatattttatgtgattgtttctaaaaataaaaattctcaagttaaagaattaattattttacgcagttttttttttcttttttgtgtgtgatggggagggggagtaagttcaatagataacttcatttttacttctacaattttcattaattcgtttatttctctttgcaattgaagtggccggttaaattattacgaaaagtcataatttatttcaaatcatttatgtgtatctttcatcatttgtttgcccaagatctttataaacctttcgattagaagtccaactttaaggtaccacacatttcttggagacttttggtggatcacgattacactaatttcataaatcctttaaagcaattcttgttaacaagatattgccatagtcgtttaatttactccccaacctacccatcaataatcaaagattctctattcctgcagtttttgtcgtctaatctgttatttccacgacaaaatgaaaggaatatttgcctcttcccgaggataagatagtaaagccatcattaatttgaagcttaagtcataatttatggtcaaaaagtgaatgcagaaaacccaaggtctatagggttgaaaaaaggaccatgtttcagggaaacaagtaacgtgtttggacagtaattttcaatgcatgcattaagcacccaatgttcttctactttcatgcatcttaaatttcaataatatatggggccagcacaaagaatttgatcaccaaaagagacacaattggagttgggattccccctgtaaaagtgtgtactatttggtgcttattggtcacacacatttacataacatgttctttatcatacaaaattctgatttcttgcagtaaaagtgtgcagtgttttctaccctaaaggagaattgcattaaccaacatggtgtgacatagttaaaagataattttatctcttatacatatatatagttaggacttgatcacatgccaatgcatataaaaaaatatcttagaaagagattgactccttaaacatatatgaatagtttgggaaattagttatggacttcccgaccaagagatagtctgataccccaacttcataaaataaaataaaaaaaaaaaaaaaaagcagaaatgcatggatttgaatttgctaaggtgaatgttagttaattggatgtgaccaattaatagtagcttattgttacattaataatgataactttatcattcataaagatcttactcgatttgagcataattagcatagtctttaaaaaaaaatatagtgcatatttttctcttcgttttgtttcaataatttactttggtgcaggtgccagaaagtgtagtggacaagaggtcaagtgcatataacaaaggaagggtgtttatccatggggctggtgagagcacagcaaatgcctacaagaaacaattccaaacagacttggcaggctttctgagggcaaggtcagtggagatgaagagagaggggtccatgttcttagtttgcttggccagaacttcagtggaccccacagaccaaggtggggctggccttctttttgggacccattttcaggatgcttgggatgatcttgtccaagaggtaattatcataatcacaaacatttttatgcatgcttgcttgtgtcaacagtggcacatagcctctatttcccattggctgaccaaaaagaagtttgagacactgtagagattaaaagacaaatatgctcaagtgttgtaggcatcaccccaacttatcatgagttttctctggccacgtttaaaataaattggtcccagccgttgattagccacccctatattgatctagccgtccatttcttgatcatcatgtcggcataaatgataattaatttccggctggctgtgtcttgtggtccataatgttgaccaacaattaggctttggatatcttaagagcttagaacaaacactgaatcacatcgatcatcatgtcttaaagctatagacaaaatggatatgcattcatctgatcaattttcatacaaagatcattgccaatgggacacaacaatgtctttgaacacagtcaaaggcatgtacttataagaaacatcctctaccatgttacacatccaaattccaaaactgtaatcaatgaagtacagaatataacgacaccaacatagtaggatgtgttgagtactttagaacattttcagttactcaaacatatgtcatggtaaatctcacttaccaacttaacactatagatataaggataatttcacattatagttgagtatatatacattattaatagaatggtagatctaaattgtcatatattactgatgttagaatttatttttttgttaccttttcaaaagcagaagtcttgatttaatttcaagaccaattcactatctatccttttatgaattgatatgaacatgttattttatagtaaatcatattcttgatttcagggattgattagccaagaaaaacgagacaattttaacattccagtctatgcagcaagcctgcaagacttcaaggaggtggttgaggctaatggttcatttgccatagacaagcttgaggtattcaaaggaggaagtccacttgtggtgaaccaaccagatgatgcaagtgaagtaggaagggctctagccaacagctgcaggactgtgtctggagtccttgttgatgcccacattggtgacaaactaagtgaggaactttttctaagagtggaacgtcgagccactagtcatgccaaagaactattagagcaactacaattctttcacatagttgcatccctttcttttgctcaaatgattagagactgagagaaaaagggtcacttgaagataactagacgacaaagactttttctccacaccctcccccccccccccccctctctcccctactctttgtgtgttgtgttattgcataggaggagtcagaaagagaaaagagaggttgaaaacacttccaacctactgttttttctccctcttttgcgtgttgtttgtgtgtcatattgctgactctagttacttgctgcgcattatgcgctttctgacttgtgttcccttggatcgatctgaactaattttgctctctacatagcatacatattatagtgtccatatcttgtgagagtcgtatgaatggaacttgtaccttacaagctgggttgttagatagaccacttgatttagtcacagtttgctttcttccttgtcctcatcaatctaacacttttttttaatatttcattagcaaatctaattggtagataaatgattaattctgttctgttataatttaaaggttgaaagatggctttttctggcttgtcctataacatttttaatagtagttggatgctaccattatattgtgccatgccaaccatgcattgttaaatctgctgaccaagaaccaaacctgatatacatatttagttagtaggaacaaagggaaaacttccccaaagaaatgagtaatgcagagaagaaggaaaaggaatcctattaaaacaaacagaaaacagctgggaagggggaaaaaaaaacagaataggatattatcagcggatgaaaagtgttctaagcaactgatattgaaaccagtggcggatctaccttcaaggttggggggcagtgccccccccttaaattttcaggataaaaattaccaatatgccttatatacatgctaatggaagtgctcaaaaactgagacaaagaagacaagaaccagggagagtgcagagtgccatagttgatgatggaaacaaggaaatcatcctcgtaactgtagtgattattttctcttaatatgcccatttattgggttcggtttgaaaatgggccacaatgcagctgacataaaagttaaatggtatgataaaagttgagttcagtttgaattaataataagtttctaaaattataagtagtttattaataatttaagtacaaaattaaaagaaaaggagcttttgaaaaagctacaaggaggaacttattttcagcttaggtgaagcttttttacaaaataattctttgattctagcaaataacattcatctttctatttatttttcttttattgaaacctatggccatttatctttccatttcatcacaaaatctgcttagcttatttttcttttgctagccttttacatttgttatatttccttctgttttaatataagacactttcaacgtaatcacaaaaactaataaaagtaggtaattcaaatgtttttaatgattttattctgaaacgaggaaatcatcctcgtaaatggcattgtcactccatcatgactagagagtattttggaccagattgaggatttgcagatggtgtaattgttaaagaggtcagtgaaaaaacttttcgtatatgcaaggagttgatagatggtgttattcttgtaagtcgtgattcaatttatacgtcaataaaagtaagattttattttgcttgtaaagtttgtattctaaatctctgatgctatatatatttttcatgtttatatttataactttatatatatacttctctactctctagtatcttctgtgaatgttagaaaatttattgtttgttcctttggattatggtttataattatttgttcttttaattattgtttacaataaaaaaaaaattcaggagcgttatccccgaacccctgccactaagtatgtggatgtcactggtgcccccttgattatttttctggatccgccactgattgaaaccaccttaaaatgaaaccaacatggaagcaagaaattctcaaacaccaatatacatattatctgacagtttagaaccttacaaatagtcacgatcacattgtaggtggatcactaactcggattcttagctatgtctgagattttgatccattattcttgcactccaaatctctagcacatactttccaaaaacgataggagagacacatcattctagtaaactcacaattcacattaaacagattgaggatagaaactaattaatgcactaacactcattaaaatccatctttaatggatacaaaaatgatagtctccgacacttctggcagtctaaagctcacccttttcttcaccttactactttggcttctagtcaatggattaaaccccatttcttttacatcaaacttttcatctttcaaatttgaataatcatcaccatttgaaagttgctccaaagacaaactatattcctcccagtcagaaaaataggcactttctctagctattgagggataatcacagttagggccatgctttaaatcacaatgatcaccgttgcagttaccatgcttttccataattggtgattttagaagccactcctctaatgtgagctccttccccattttctgatgctgctcctctttattcttcttcttttgcatcaccttcttaataagaaagtaagtttgcttgatatttttgacaatccatactactgaactggcctttacaaaacatgagtcttccttaggtaatctttggcgcctaaaataagcctcagaacaacagaatgaaaagttaattcccattccgtttgtttaattgcaaatgggaagggtcataaggatagtggtatagactgctaagtctattatataggacacctaagacgtattatccaagagttaagaatattacactccatgcctttgttaatatcaagaagaaattaaggaacataattgatgaatggataaccttaatttattttttacagattaaataagcatgaataaaaccttttgcagtttatttcttcttcttatcacttttgataaataaaatatcacgaccacaactagtaattctgaatatctcagccacttatttataattatatgcatatatattagagagtactagtggccgttcaatgtttatatttgaagtaaagtgttaggtgcaattttacattagttagaaattgaaagattgaatatcacataagtaataggaaaattcataaatttgagggttttgagttgaaatatgatgtaagttcatttatgtggtgtgctcaaggtctattggtgtaaattttctgatgtttatcttatcgattgcacaacaattgctatgatgaaaatgaagacaaaattcttagcttatttgtcaggataagtcttaggcagtgacatttagtttggcggtgaagacaaggcttcccaatcaaacacataaagacattgttgacttgaagaaacacagttaacgttgcggctgagaactatttgccttggttgcatctaccaaactaccaaattgctcctgtaaaaggtaaccctaaaatcaagctagcagtaccattggagcaggaatttataaacaatattcatgaatgaatatccaagttgaagacagcatcctaaactaaactatgttggagtgaagacaaaattgcaagactgacaaacagtgaagcaaaagcctgagactccaattatatgatcgctttgtgttcaactgttcctctatcatcacaaccgcagataaagttgttcctatgccatatcccatgaatcgatcaagaaaggataaatttaaataaataatacaaattaaataaataatttgaaaaatgggacagttttgaaaatattttgaaatctgggcctgtgtaacacacccaaaatagacatgtttaaacacgtccaatttagacgtgtttcagctagttgtgacacgtgtcatacatgcacagtgtcgagcgaacttcgaacgatcataacttttgataggaatgtccgattgagacgtacgatatgtcaaaacgctcgaaattcagagaggaaggcttggacaactccccaaagggaaattggtcaactgttttttttaaaaaaggtctctaagtatctcaaaattacgatttatgattcaatcagtcaaaaattttcaaacaggttacttttttaattatttaattagttaatttaatgttattttctatttttttaattacttctcttaatttcgagcattttgacatatcgtacacctccatcggatatttctataaaaaattatgactgtttaaagtttatacgctcaaaattcacttgaactcaaaatttatgcatgtgttacaaaccaatttgaaatctattaccaattttgtttgcaaatcaaatcaacaatagtaccatgttaatgtatgaaagttttgtcccatattaagatgacgccatcttttttctttggtctcttatttatttcttttatcaataaatagaaattttattaaggagcatagggggtactttaatccaatatatatatatatatatataaattatttgttagatttgttgttttcagttttggatctctttttaaaaatatttttagaaaaaatgttttctaaattttaagtaaataatttttactcttattttttattttctttgaaatgaaaataaaaaatacttaaatgaagctccaccttaatttgtagttgttatcggtattggtttgagattagagtagtgtgtatttgtttagtcaaagcaaaaataagagagacaaagaaaattaaatactaaaaagaaaacaaaagttaaaaattaaagggaagagattttgatcgtatttttcccttttacattctccatttttctcctatctatttaagaactagatttatatattaaggtttaggttagacagaggagataataggttccgcaagtaggactaccatagttttaggtttcttctacatattaccagaaaatgagaaatgaaagtttttttatacacattctttttttgccaaataacccaaataaggtaatgtgattttggtatatctatttaccaaaattatactgtaaattttaacgatttcagtttaaaaaaattaaaaaattacaatattgcggccgcaacactaatttcgaaaattgaaaaaattataatgtaaatttaaaaattgattttaaagtcgtatgctaatttcagtctctattttagtctataatacattttgtgacggaattcatggtcgcaaacatttagcgatggaaattgtggtcgcaaacatttaacgagcaaattaacgacggaagtgatttgggcgtgtttgacaattccggatttcaaattattttaaaaacggctattttttgaattatttattaaaaaagtattatttatttaaatttgccaaaagaaagtaccttttaactaaaattcatttattgaacgacatgcaacatattactttattgctaatgtagttcaaattaactatcatttggatggtttggacaggtaacagattcaacataaagggtgtagctctcaatttttccccctaataaacattgaatcagctatacagattttgataatacttaaaattaagataactcgtccttggagctttggatttgtctcttttaaagtaaacaactcaccttagaagataaagtaatatcggtcgttgataaaaaaaaataaaaaaatcaattgttaatattatgtttatggtgcacgcataacaaattaaatgcgttgaaatatcaactgcgaaatttcttattaacaactgaaattacttacttttcccctactcattttagaggagtcatgaaaattcagacttgcattttaccgtgttcaaaaattacttataattaaatttttcatggagatttgtttttaaaaaatatacatttttcgctaaacaataatcaaagcccaacatgtaccatacagaagaggtaaatgacgctatcatcctcagagtggaaaagacccaaaaagaaaaacaatgtgaggtgagattgtttttcatttctataccgttggaccactgctttttctcttgggcttttgtggcccttttccacttgtattgaagaccaatactaaatgttacgaatagatttcgtaacaaacacgcgaaaggtgttttctgcctaatttttctttatatttttttaattattttaaggaaaataccatttgtgcgaattcgtaccgcacggattatctatacaataactatctcctcctgaattgagtcaaaagcctagttttttttataaaaaaaaattcaatatctatccaattatatttaaacaagtagattcgtagtaaaaaaaaaaaaaaatcgcactgtatagcatcgctgttattttaatcaacatttatttttaaaaacactgcaacatagatcttatgcttcgtgcgcctattttctcgtacaagcagcagcatagttgtccgataactggatggacttcccagaggcaaaaatcttttcattccagtatggcaaaaaaaaaaaaagaccctcatgtaatgcaaggcaactacgatttaaggaccataaaaagggttacttgtttctctgttaggtttgctgcagctttcttttgcaggtccagacacaacagtttctaagcaatgttccccaacagaaatgtcaagggtaaaaaagttatgtaatatggtagatttaagttaagatgtggaattattctatggatctgtttgtttaaatggttcaataagatgatcaagcgttgaaggctcactgtgactgatatcggagttcgaaggataagatggttttttggtttcttgtcaagtctctgtcaatgtcccagtgacgacacaatcacggtaggttaaaagttaaaacagatcagaataacatttcttggcatagccataagaagattcaactgttggatcttttcagatgataacccaaataccctaacttaatccacactcccgctccttgcttgaaaggaaacgggagtttaaggataatatggttaaacctaccaaacttattccaatttagttttcatctgacaatttccgtcaatacaatgtggcccggctatacagctgccagaactcatcactatcttctaaaaattatgccaaaccaaattgtactaatctctgaaatggaacttaagcaacaagttattatgatgtactaaggaatttcacaactgagattcaaatcctcagggtcaatgggtgaatgaacactaacctgaatttgagtgcaagaccaaaacaaaaaaagaaaaagagaattgtcccagacagaactgaaattcatcaagcagacatctcttatatgtattacaattccttgacaaacaagccaatctcaataactaccagataaacaagaaagattgcagtcccagcagattttatgatttccattcatcttccccaaatttcttcacacttaaaatgcatgatgtatgtaatatacaaaacaaggcatgcaaataataggtagaaaaaccattgaaatccacatttcgatttacataacatcttactggccagctgatggatttgtcaacaactcaagggatttcttcaagtagtctactgcaattgagacatcatcaaatgccagtgccccaacagcaaatcttgcagccttgtgtgcttctgctattttttcaggtgctggctggtagttactgtcatactggtatgtctgagtagttgacttaggttccacaacagttccatttctgctgctggaactgtgttgagcacttgatgaatggtttgcagttagcggagccgactgggaagaatatgaagcatctgacccttgataataagtataatttgatgggacagagggaaggctgctttctgtaaaacttggataagactgaaaatggggataagaaaaagaggaagtttcatgagaagggtaattaggatctaaatgctgtgaattctctggtgagtattgctgatggttgtagggctcaggataagaactttctgatctggcaggtggaggatggtaatcttgggaaggtggaggaggatgataatcttgggaaggtggaggaggatgatagtcttgggaaggtggaggaggatgatagtcttgggaaggtggaggagaatgataatcttgggaatgataatcttgggaaggtggggtgggatggtagtcttgggaaggataaactccaggtgtgtaagagtgagatgatggagaaacaatggaagaatgcttgttattatctactttgtcatgaaaaggcatagatggtggaatatttgcagaatgttggtcgttaccagtatcatgaaatttaggagcaggatgaatgcttggcagattctggtagttgacagggctatgataactacgtgatgaatcagattctggtccaggactggaaacagtagtttcggtagtcccaaggtcctgcaagaataaacagctcaatgttaattgtttatatttattaatgaatttatttatatgtttttttaactgatcaaacccagaagacaccaggtgaagttttgaatcatacatatctatcacttgaagaactcaaaggaactgagaggtcctcatcaccatcaggggggccagcagtgggcttccttccttctttcaaagcttttcttatttcagctgctttccacactgcatatttctgtttctgctccagctgtaaaagaaactcaaaaaagcattaaacatacagttacaggaagttgtattcttgctgcaaattgtttccaaataagaaaggctttgtggaaaacatgcaaatgcaatgagacatgcataaataaggaaggttcaattctatgcatgaaatacacacatcaggctgaaccgctccaaattgattaagaatctcaaaaaagatgctggcagcataaaatgttttcgctgtattcctgcaaagtgtcaaagaatatacgttaaaaacttatcacagatgaaaaattcttacaagcaagatagttatgcaaagggttttttaataatactatagcaaatgtttggcaaaagacagatgcttggtatgtaaagagagtgagctactatcttgttcaagacaaagaaacaagaagatacaaaaaacccttgtaaactttactgagagtctgagaccatagggatcacagctgatgcaacagaaccaacatacaagcttaaaggcttatttatttatttcaagctagcattaaaataaaaagagtgattttattatacaaatctgctcttccggcacgatcttgcttgtctgcttttccaaacacattagaagaaaatccctcgagatataaattgtcttcaggccccaactgaattgactttttatcctgtaaaaacaacatatttcagatacatcaattgagtaaataaaaattccataatcatacccaatcaaacatgtcaaccactaacatcttcaaaggaaagaaaactgcagattgccactgaaacatgccatagtatcattaattcattattattcacattcagacacttccatttaacatgagcagattcccttcttattttaaaaatcaacacaaagggatccacgagattaattaaaaaatcacttttatatttatttatttgcggatcacctttgagtttcagttaattgtgattacagtcagcataaaaaaacaacaaggtttactttagaaccttttcaagctgcttcatgagggaaaccagaagagcattagtggtcttcgtgcgctcactttgcggaatcttcagcccccgttccatagcatataatcgacctaattttaccaaaaaaaatatttcatcgtgataatttataacgacgattagagtatttcagatcagtgaaacaacaaaaattgccataatgaaaaataggtatcgatctaaaattaaaataaaagagagaattacagtaataagcgacgagtggttcgtgcttttgcaattcatcagcgcgttgaaggtatggtaacagcagcttcgcgggttcgttctcgttcgccatctcaattctcgcaaaaattcaaaacgcagaaggtattggaaaccacacgacgtcgtttgttggctttattccaaacttatgccttcgaccgtctttccctgccaaacaacaattaaggaaaaaaaaaaaaaacttctcagctaagaaaaagtaattgctgtgataatttaaaactgaataaggaattataaataatatattatgttatatttaaaaataatcaattcatatgttcgtgctattttttattttaaattatcaatttagtcatttgcaagatcattgatgaaaaggatgacttttagaagcatacaatttaatttcatgaattcagttaagagggaatgctacacattttctttgatattctccatcaatgattctgattgcttagaatttattaaaaatcattaattttaataggttttgttactcattcaatataaattagaagaaaaaataattaaatgataaataaaacctattaaaaatggtaatttctaatacattctaacaaattatagagagaatcctataaaaaatgtgtgtgtgtgtgtgtgtgttgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgagagagagagagagagagagagagagagagagtgtagttagcattattcttcaagtaattagatattcatttacgatatgcttagctactagaatatgagaaaaatagatgaaaaattaaaattttctcttcttcaaatacaaatcaatgcaactcaataaataaatttagggggctagagaggacaagaacattttactattaaaggtttaattggactatttaggagttagtattaagaggaaatatttaaataatttatgcattaacaatataaaaaattatattattattttatcattgacatgtctgaaaaggtttttttactttttcaataataataaaaatgagaaacatatattttaatcaccgtatttagttaaactttattttagtctctatacttttaaattgatgaatttattccttcaactttaaaaaatgaaaatttaatccctcttcttgtttaaatttaacatttagtattaatttatatattttctaaagttgaagggctaatcaatttgaatgtacaaggaccaaaactaagtttaaccggtacaaagataataaaaaatcctaagaaaaataaacataccattcatacaaactaaactgttattaaatgttttagaggttttaaagtataagtaaaataagttcaaataccactaatatgttgatgattcccaatgggtagtacaaaaattactcttgattgataagtaattacccacttaacgagaatgatatttaggatttagatacaagcaatacgaacaaattttgacggataagaatgcagatataagtatcttagtatcaactctaccattttcaatgcattaagcaggtaagcaaaaataattattgttataaagattattttgtatcgtcaattgaactttgcacatcactcaaaactctaaataaccaaatctcaccactaaggacatggtttaactagtacaaaattgtctcatattaacaaccgatcttgagtttgaatcattagtatttatccatttaatactcaattaaagaatgttattcttcatagtaattctatcaatctcgagcaatctcgagccaaattgtcacatgtcacatatgaaagatacatggaatttctaaaagaaaaaaccctttatacccttttctttttgtaggtaattaattttatacaacttgaataataagtaacatttgattaataataccccatgcttgaaaaatactatgcgattaggaccattttattgcttgcaccgtcagtggaaataattaagaataataggttcaaatatataaaattaaataatacaatatataaaaatatgagagtagtgaattcaaatatataaaattaggggaacaaaatataaaaatattaaataattatatgtatttttttaaagtgaagagatggtatatacaccctccctatgttggagatccgagatctgccactgtgccctgtgacttaaatatttatgaaaacccaattgccatggacatgatgctgaaaactgaaacatctcacaaggagaaaatgtgtgttcggaaatttgcatttgacagcatgaagccggacagcgtgagcaactatttgttgcttctgcattttttccattctttgacgtgaaattgcagggtagacgtgcatatgtaacatcatttttttaagattatgtaacaccatttcaaacactgaaagtgaaacaaaccaatgaatagaagctagggtttggaaaaaggcaagactagcactgaagactgtatattttcatattatagggcatatctattgagaaaacctccaaatggcaaattgaacatacacagctcagaacagttcctctctaattacttgtcactcccatattataattcctaaagcactagtaatttgacaatgctacaaagatgaaattatagggttgaaaatgaagatctcattattagggtgatgccgggatgggttcagtaccagaaacatgggaagcagcatcttcttttgacatggccacataattcacgggagcagatagtctgttttccctttttccatcttttgatgtggacttgtttccattttgatgagcattaagcgatagccgtcggttaggagtaccattggctcctccgttagcacgaggacctcctgacttactggaactaactggcctagcagggctgggtcttgaaccaaagatggtttcttgttctgtgtttcgctgctcgtgatgctttttctgatcctacaaagtgcaaagtccatatgttatgacctctccgtaccacagtatgtataacaaatatagaatagtagtgaacaaaacagaaataggccaagctgatagttttaatttcctcgcagagttgtggtcttattactattagcaattgctcaaatcaagctgaaaatgagtaatcctaatcatcttattagtgaaaattaccctcatcctccgtttttcctcttcccgttcatgtctgagcatggcatattcatctaacatggcaagaagaggaacgccatcatatgtaaatgacatgccatgatcttcttcccatgcacgagttttagcaaccaatgtatcaaccaaagctgcattttcaccaacagaaacaaaattattccaataatgtggcatcatcttgttttgcttacactgacagcagattgaattaataataacagtatctgatggtgattgtaatctcattcaacaaatacctggaattttgttgaccaatatccgagctttctctgcacgtttgaggtttatgtgtgcacctctgcttgcattatacctgttctcatcctgttttacaaggttgtgtcagagtgtaacattataatccaaatgaggaggattaggcaaccatttaaagatcataacttgcagcaaagctaatgctaaaaatctaaatatttccggaaacagggaaaaaaacatttcaattatcttttcaaataacaaatcacttaaactgaaaactagcagactatataataaagacggatacagattaactctggctaaaggatttacaatttttgttaacatgatagtaaatgttcttatcataatactactacatcacctctctatccacggctgtgcacaaccaatcattcaaactcagaaagagaaataaagcagaagcgagattttaagtacccggttatagtcttcaagccaactctcttcttcacatgctgacatccatttctcaaccttgtccaatatatcttttcggcttaaagcttcttcttttgcttttgctatctgattgtccatgtcagccagtaattcagttggttcaatgtttcctgaatcaatcattgccataatcttctcccgggcagcatctggatctacttctatatgagcacgggcaaatatctcttcaagctctgcctgcttcttgaaagcaatttccttcatcctgctggctttcagctgatcaagtctctcaacttccacttcagcctttattattcaacaaaaaaaaaaaaaaaaaaaagttaataacatacttggagctcgaatctgtaaacttcagaagttctgtagtacctgctcaatcagatccagagcaagggcaccaggaacagtgacttcatcaacagaagctgacatattacaggtaacatgatcaaatagtctcctttcctcgggatgagtatccattagattccaaagatcaatcaactgagaagctaattcttggagctgcatgaaatatccaggtcaaagtaaagaaaatggtattagattaaaagtcaagcaagtaatgaatgcaaaacattttgtcggtaatatcactctggggtgtcaaagtcagaattgatggtgatttcttgaaaacatacacatgattagcaagacaaaaaccacagtatatcaaaaatcctaaaatttgatagcttatacagttaacagctattgcataaatgaaaattaaggggaagaaatgttctaaatgcattaccttgtgcagcctctgttttttatcttctttcagtgttaagacagtcttagccagccttgctagggtgtcattacttatgctcttcgattgaacaccagtagagtcatttagacttggatgaacctcagttacagtactgaagaagtccataccaaggacagcacatagatcatgcacagtactcacaaattcaagaaccttgtgcaacctctcgctctgccaaacaaggcaatgcaacaaaactctcaatgagctgtttagtgaatgaaatcaaatggaattttccaaattagtgacaaactgaaatgacacattattgaatattataacaaaattaccttttccttttgaagttcttggagctcagattgatattcatctaacttcttcagggacaggtcagactcatcaactgcaggtgaaacatcattaaggttcaagtttccggctatctctccacatatttgttggatctgtgactgtacatccgagaactccttaattctttcttccttttgttgccataactgttcaagtaccggtgctatagctgcaagctgttctttgatagttccagaagtattctcaggctgtgaaagaataaaaaatatgcataggaaattagtttgccactttactaacaatataagacatagtcaggtagttactaacaattccagcaatgctcttttctccaagtgctgatagaagagtggaaagctcaagcttagcatcagacagagcttgaagtagctgcgcccttgacttggcagcctgctcaacctttctcttgtacacatccaagcactcctgctctaactgaagaagcatcttgtctcgttgctcgtcgctctcaccaacctcatcccatatttcctacagcgaataaagaaaatgtaattacttaatcccattattctgtagagcattcgcatcttaagtgacacagatgaactgttgaatgaagttagttacctgaagcttttttaacaaggaaccacatgtgttttctccaagaagaggattttgagcttcggtcactgccattgaagtcccagcgacacctagcctgcacctcaaaatataaaaatgacatgaaaattctttctgcttccaccaaacgcatagagaaacatttcttctcttccatgaagatcaagaaagtagaagacatctgctataagacaatgcaaatgcaattaaagcataattaaatgcaaagccgtaatccatcgtgggtaaatgttgaattccggtaacccaaaattacccatcccaacaactaaactaacgaattcaaataaggatctttgaagagataagccaaaaaaaaaaaaaaaaatcttaatattaataaaaataataattaattaattattgttaaaaagtaaaaagttttttaattgcatctgtaaagaagtcggattttgttcattacatatgacatgatcataatccaatgcagaggtaagctaattaagctaacgatcacaacagaatgaaatgagtcgacgaaacggaagctataataacccaatgatcagcaacaagtagcaagaaaatgcgatgatcgagaaaaaagagagggaaatgttcaccgtcaagctaaagaaaagaacgaagcttgaaaagaatagacgaaagaaagaaagaaacgcagcgtagaacaagaagttgagacggagctcacttgcattcacagagcaacgaggaagaagcagatcttgggggatgcggagatcagacgaagaagaagaagaagaagaagaagaagtcgctggagagaagaatgcgtaccgtttgaaggttagggttatgtggcttcagatctgaaacagagcgtgagcgagtgagttcgtgaaagagagagaaagagagagtgaggttgtgttgtgtagagtgtgcatataataatggggtcataagaataagattagatgatgagatttattagaacgaacttagatgatgcaaaagatagagtacagtgttagtgtaggaaaacaaaatggacccacaatgactatctatgatctatcttttcccttgtctagttccaagtcaattcgtttcttgccccaactcttcccccttatttacgatcatgacactgtgtctaaagtctccctcactcttcatttttttcaaatgttaccataaaaactttgactttgactctcggtctgtctaatgaattttatttaagatttaaatttactctcaattcaaaaagttgtgtattcatggaaaatttatagataattattagaatttaacttttatgtgttgtcggtataaagatttttatacagtctaccaattaaaaaaatatatatgtttttaaggatagttattataaaaattaataaatccttcatacaaacataactaaagcctagaaaaagaaactcgcataacaagaaagctgtcaatgggtgaggagaagaatctaaaacagtgaatatatctgatgatgatgatcccatatgaactaatcgatatatatacgcattgctcctcttctcgatagacatggttaaaacttaggacccaaagtctattcttgaaagattgaatagagtttatcaaagcagcatacgaatgccaaggaggttgatcatgattaataagatccaaagccacaagtgagtatgattcgcattcaacaattaaaagacaatgtttaaaaatttacactatcaatgtattttaattactattattgttatttataataattatcttactataatttattagggtcttattaatcagtatttttatgacattgtttaaaaaattaaaagaagagaatatttatttgtaaaaaccattgaaaaatataaaaaatcataaacaatacatttttgtgtattttaaatttagtaaaaatttagtttttaattttttaaccaatgcatcaagtaaataacctttctaaatttattactactatcttttaatatttttttcatattaataacataccaccttcttataactgccaaaatctaagtgtgtatttgcatatatcggctaaagtcaaaaagtgcggcctctcatattctgttttgtgagaagaaagtatttctattttctaaagttaggaaaaggtctgtttgggatattcccaacagaaaaacaaacacaggcttaaacaagagagaaatcgtttatttccatccacctaaacacattaccaaaagaatccattattcacttctaagtacagggtaagttgtttacggaaaagcaattaatgagcatgcacctcaaattgccattttatcacattacaaggcaactaagtattgcgccatgctcatgtcacagcaccagttatggggtaagcattgagctactattcaatttccgtgggtctaattaaaaaagaaagaaaataaaatgcaaaaataatatgaaatgcttgtaaaaattactatcaaaagccagcaaatagttagaaaaccatagaaaacataatggaattgataaaaaaatttgcaaacaattaaattagaaatcgtaaaagtgtaaatagttaattatgttcgagataaactcaatcgggagatgtttcaacttatattcctaatgtaatttccattacagatggccaaatattcttatctgccgatcttcttcccgtacagagtctgtcaaactccgctgtcttaaatgacattggcgcggtactctgatatgagtagatcagatcaatcgactgttccggctaatcacgtcacgaaatagtagttactcccagcccctttcctttacagaagaacaaaaaagtttattagttgcatccgaggttcaaagccctgctcatagaaggaccaatcttgtgaaggacgcagagggctaattccttctcgtcgctcaatctggagtaagaagccggctaccagcacgagtgtacacatcttgggattcaaaagggcttctgcttccctagtgaatgtcttggtagaagatatgatttctttgaattgaggtttattcgtctttaagtaagcacgtaactcaacaagaaatttcctgtcgagagttcggattgctctacctaagtagaacgaaaagaaggaattggaaattcaacaacaaagggagagccagaagcttcgcttccggtagggggatattagattgattgtatccatatggggtaataataaaagggggaggagagcttaaaaaaacaagatagataacaaataaagtagaagtgcgggaggtcaaactggagattcatattgatcaatcgatctccgcgtcctgccagttcgctaagtagactcactctcccgaggggcaacaatggaactcttcctgccaaaaactaatcataaacatttttataaaaaaaaaaaataaagattgattaatattttatgaaagattatctccctcactagactcaatcttctatgatactctacctgcaataatgatttattattttgttttgaaaccatgtgcttattttttagggattttgaaaccatatgttggatgtgtgagaatgggtagtcaaagcataagaacgtggaattgcaggctagaatacgtccatggagtgcaataaaggccaatatcgttataaaatttaagggcaggggcaattgctagcaacaaatgggggaatgttaccctttttctaaaaaaaattgtgaataattatttaacctgaaaaaaagcagaggataggaaaactccatagatgggcaaaggcaaaggtcgcggtcagggatagggttgtcatcacgaatccaacacgtctctgtccaaatgagtaatgacagcatcaatgtgaagctacctatatttctgtttagtgtataatatataacccttctgcaacgtgacaacattttcatttcatcactttccttggaccataacttgcattctcattattctacgtaagccatccattatgagaataattataattttatcatcaattgatcatgcgcgggatagcctctatatccctacatataaatataattgctgcatttgggatggcctacgtttcaggccttttaatttattcagtaatatattatgtatctatcattgcatgaagtgcatatgatatgaccccaaaactactacccctggtgcaaaattcgaatttaccaattaattggatggtttaaaacatgaatcggtgtataattaactggtttgataataagcttatttaatgatattaataaattattggttaaaatgatattgagcttaattttattaagtaatatcttatgtttgaattttgtgaatgaaataatataattaaaagaaaaaatttcactcaaaatgatcaatcaatttttaaaaaaaataataattttatcagtgaatactccatcctcgtaacatgattaaaaaaattgatctgactctaattcatatatgtatgtgatcaaactaactaaattaaagttataaaaaaaactaattaaatgaaaagctaagaataaaaatcaggcaatgattcatttatgcatgcataatagtagagacgtcacacttcgtccatcattttttccacttgtatattttcttttattttcttccttttaatttaagacaaaatgaaagggcagagacagagtggctttcaaatctcatttaatttatagagtagaaaacaaattattgcttgtatatcaataataatactatcctttttcgatgtggcaatcatgaaattaaaaattggttacatgatcatcaagtacataactgaggtaagccgtaagctttttaatttgaccaactgtgtgaataagtagatgagagagtacagttttagttagaaaaaagtacgagtaataaattattagctcttttatcatccaacctcccactctcaccaatgtccgtcgaatcagttaagtaattaacttgaatatgaacttaaaagacacaaaagttgtgtcactctttaaggtctcacggggatcgctccatagtttaggatttatttgataaagtaatcctttcattcctcatttatgtttttagtttttttaaaagttttattttagttttataaagtatttttgttatattaaattaatatttccgacaatttaccacattaatattattaatcatggttgatgtgataattgtcgattcctttaaataaactaaaagaccaatttaatctaataaatacactttaacaagctaaagtaaaactttttaaataagatcaaactgaaacttaaaaaaaaaaaaaagaggagagtctaaaaaaaatattttatccttttgtttttctttattctggataatgatatttaaggatttttaaatttaagaattaattattgtgtagcttcaacattagaatagttgatattgcaattcttacacaagcattcgtatttttataaacaactcgttcttaacaggtcttaagaattgtgagacaaatgtataattaattttaaatttttaaaaattgtacaagtgaaattgttgaaattcttcaatctcatgtaatcttctaaaacccactaaggaggtgtttggtacatattggtatatatataaataatttttttagttgattatagatatttatgagtttttttaaagaaaaatataatatttttattataaattttaattattaatcacattaaataatttaataagaataatataatatttttatcacattattttttttataactagagtaagttagatttctaatttcccgtggaaacaactttatggaaaacttagcaaaatttattcacggacaacatttttttcttctagaaatgttacgcaaggttctaaaaactaaaaacttcttctttatcaagcgtctcctcctaaaaaataagatttagctcaactaacgtacagtctctaactttagagaaaccaaatcttacaaaataagttagagagtaaattacaacaatactcattgagcttttattaaattacatataatcttacccttttttattttcctacattaatctctttatatttaaaaatattttactaatatcatcttatatatgttggataatattattctgatactccctaacatttccttaaatcttaaaccaacactttctattagaaatatgaatgtaatagttaaaaatataaaaaatatttatataattacatgaaatattgtgaggtattattttaatttgttccaaattagacaactctatcgtaattacaatattttagatggtgttacaaacatatttccttacatgttttatacaaatctatcattatttatttttctctttttcacaaattctctttttttctctatacaatacccggtttaaattttctgaggtctacgataattttctggttaagaatcattatcattttattctgatatgttatgaattaagggtgtggtattttatttacctgccgccaaaagtttctatttagaccatgtattttactttatttattttagggtgtttatgacctaatagttctaaattctaatggcgctgtacaattagaaaagcaaaaaataaaaacttaagtgggaaaagtcgtcttccatttcccaaatagacgacttacactacctgggttatccttattagcacgaatgttaccaagtaccaacaatggtcttctaaatataataaagcaaaataaataaattattattcagctgttacccatggttataacatgttacccatggttataatttataaatagctaattaaattaatggttaaattcattctctttactgaagtcaaactccatcgcttaacttcattaatttcaaacaattataaaatatcatcactcaaagcaaaaccaaaattaaacccagtaatatataactttgttgtgaaacaactactgatctttactattctattaacggcaaagacattatattactcaataaaaataccagcaaattagttaaaagtaaatatgaaatccaaatttgtttggtatgaaaagtttccttcctttttgtaaactcgtaagatttgattatgaatattaatttttctaattttatatttactttatttaagtatgaattattttatgctttagtaattggtaaagttgtgctttatctagaataaaatatgaataaatatattttataactaagagaagagactaaatgtaaattttatataattcttttgtggaagtgaagtatatactagtaagaacaaagtaattccaaagagaattaaaagcttgaggggaccatgacacactaagttcgtctccctccctccacctaacaactctgtgttttttgtacttatctactactattctttagatagcacagtttcatgcttgttgctcaatacatggtgggtttagatttttttccaacacacgttatgtcctgtccgaaaatcaataatcaagatgccaacaatggaagacacatgtgggttggggccatgcaacatgtgacctacgcagggaattaatataataagatctggaacttgagaatttgcatagttgcatttgaccagcccaaagcacaatttctaacgcagtcacatgcatttgtattctcaattatttgctaatcatcgaccaaagtgaccatcttagctaaaattaaacagtgtggtttaattataatggcatcatctctcatgtgattgtattttattataggcacaaatctttgtaagccctgttcttgttctctctcgtatcatacctactttctttcttgtcgaattatacctacttccttgatgattaaatatatcgtcatcgtggacccaattctttggtttgccacaattgttgttacgccaactgaatggaattaatgttcgttctaattatagtttaatagaacttttgattagttagggcttttttattttattacttattttttaattttaggttttgatcctctaatttttagaaatgattcaattagatctttttttaaaaaaattatttaggtcctttattatttaaaataaattcaatttgatcctaattttcttttgtctactccaatatttttttttaaaaaaataagatcaaatttgattttaaataggatcaaattgaatccatttaaaaaaaataagagacttaacttctaaaaacaaaacgacctaattgaaatatttttaaaaattagagaacctaattaaaaaatttaatactaagaggatcaaattaaattttaaaaataaattagaggaccaaaataacaattaatccttaattttacgttgctgacaattaattgtagtatctctgcattttagaaagaataagttatttccaaccatttaaaaaaaaaaacaaaactgtaataattaggaaaatcgtgtctatagacacacgttacaaacacagaaaaattgataaattcccactaaaaatgtgggccgggttgggctggtccacttttataaagtgggctgaaaatgtcaatccaccccactttaaggtgagttagtgggccagcgggccagcccactaacccaccttaaaaatatttaataaaaaaataaaaaatatttttttaaaaaaaatatttaagttatacgaaaaattaatattaaattcatgcctgcaatcattttaataccttacctcacatgagatgatgagaacttgagaaaccaaaaacaacagaatcaaacaagtcttgcaacatccattgaacttccaagaacaattaaataaaattagaatgtgaaatatttttttaaaaaaatattgtttaataatattttaaaaaaatatttaagttatactaaaaattaatgttaaattcatgtctgtaatcattttaatactttacctcacatgagatgatgagaacttaagaaaccaaaaacaacataatcaaacaagtcctgtaacattcattgaacttctaagaacaattaaacaaaattagaatgtgaaatatatatgtaaaaaccaacctaaaatccatggaaaattatatgttattagagtctaacactagattaataaatgaaattaaagtttacaaagcaacatccataattccatacattaaatttaaaatgtaaaaataatatttttttggtgggccgtggcccggtgggctggcccggcccgtcccacattttggcctgcgttttagtgggccgggttggtccggcccatttttctaatgtggctcgaagtgtcaacccaacccacatttttttgtgggttaaacgagccggcctgccgggccaggcccgttttaccaaggctacagtcatagtcgcaagaccaattatactggaaaaatatcacagttaattttttggtgaaatctaggtaaccattcagatttcagacgagaattctctatatggaattgggtatgtaattgggttactcatgccttgactccttttggatgttgatggcgttgtattgtccctctaaactgtctggttacttcttgtaccctgttctaatattaattgaaaagttaatctttgcctaaaaaaagttttgatatattaaaaatcattactatattaattacacgtacaaaaacatgaccaagccaataaatattattttgtatcatatttcattatctaagaattattaagaacataatcgtaaattgtgggaagaaccaaattaaacaaaattttaaagataaaaatcaaattaaatttaaataataaattctttaacttttataaaattaccttaaaaaatatgtaaattgtatgatatattataatgttaaattttatttcctataattagggatggcaatcaataaataggctttgagtatgatactataatatacaccctaaacttgtcttttagaaaaattcttatatttatattcatactcgatcgcgtgaataataactttaatatcatgccgtttttttggatatctaaatgttcataatcatagccattatccacattttaaaaatagtttattttaaaccacaattataaatatttattataaattgtaatcatataaaaatatttaggctaaaatataatttccatcatccacttttaaaaaatttattattttagttctcttattttttaatttagacatttcattcccttttaaaaaaaattgtgatttatcctcccatggctaatttcaaacattgaaattacatataaaaaggataaaaggtaatttacaattgttataaattacgtgtgaaaatgagaatttttagatatgaatgaaaattatattacatatttctaagaatagtatttttatatatatatattttaagtttagatttatttattattattttaaaatatattaacgttaatgatgattaaattatatattatgaaaatatatattatagattgtattttttgttagtgtagtttgatttaatattaaaattcatattatttaatttttgccttatctcaattgatttatataataataacatgaattatgttaaaaaattatttcaatcaaatcaattaaagttacacgtaggttctcatagttattagaaaaattattttttaaaataatataatttatagaaattacgaagataccatgtgtaaatttccttttcaaaaacattttccgctgtatatagtatagattaaaaatgatagtaataataatatatatttatactataataatatatattatagtataattttattaaaatttgaaatgtaaattcattaaattaaattatattagttatattatttttttaatatatattaaatcaaatcagattaattattgattcacttattcaaactcaatgtcgtaagacttattttaacgacattgctcattggcatcgagaaggagggtattattgtacaggacaactatagaattgactagtttttttgttttaagttccatgaaggtaattaagtattgttcatctgttaaacatgtcgtgttacttttatcttttatagtacattttatgatattagtaatagatttatatcataaagtttttatatttattagcgttttcagtaaccttatgggtctggacccgtcacttagtataataaagtaacccacgattattactggtcaatgcggaccattacgtatctctcgtagttaatttgttctctcctactatgtcttgtgctgttaattctcgtttccccgaaacatagcaaagccacatctaacatcataaaaaaatttctcaattcgtattgatccttttgtcattttttacctcttaaatccaagtatgtactcttaaatttcaatctgcttctccattctccattgttatttcttttttcttgatatatagtttccattatttcgttgttagaatcattatcccatttctgttttgagcacatgaaacttgtgccttacaagaaaaaagggtttcgattttgtgagtgtgtgacaatcaatgatctatttttatgtaactttaataactatatgttgggcacatgcttattgtttcaaaaaaccttgaatcaaccatcgaggctcaaactaataggtcacattgttaaattttttgttgacggacgcatgcatgcatacttacatcatcaatatcattttgtacctagtgtccactaatttcgttgcttattatactatattgttgtgtatttaactttcccaattatgaaagtgattatgtatatttagtatgagtgctgaattttgaggatacagccattttgatacattaatatgaatcctattagggatgtgtcgtttgcttttataacttttgccttctaatgtctcagggcaggtctcagtccgtgcatgtatatcactccaaaaatatttgaactatcacttcaacaatgagagatatacatacggatactaactgtagttcaccaagaacgccaaatgttcgacaaagaagacgctcaaatgaggttgatattaactgtagttcaccaagaacgccaaatgttcgacaaagaagacgctcaaatgaggttggtgtagtaaaataacatgtatgcttgtttgtgatcggggatacatttatttcaaatatcaagtttttttgtgaatttatgctgctgcaagaccagttatctatagattctgtcaattcagaaaccatttgattatgacaatatgcacaaaattattattcactcctctacacattatttcttatctatattatatccgagctatacaagacatgtatgaagagataactacgagtgtgagaactccaagagttgaaacgaagaactttcctattggggtaggattatatcacggctcagctttaagttcttgtttaacatagttttggatgtgcttatcaaggacatacaaaaaattatccctaattgcatgctttttgtggatgatataatcttgattgaagaatcaaggaaaacagttaacaataagcttgaggtaaactttggaaacaaaggattttcacttagtaggaggaagacaaagcaaatgcactacagttttagcaagagacacgaggattttggctcagaagtaaaattgggagaggatgtcataccataggtttctaattttaaatatttgggatctatcatacaaaatggtggtgaaattaatgaggatgttacattagcaagatggcttaaatggagaaaagttttagaggttgtttgtgatcgcaaagtacctaccaaactcaaaggcaagttttgtcgtatagttagatgtccagccatactatatgatagtgaatgttgggtattaaagggacatgagagaaaaatgaaagtagcaaaaatgagaatgttaagatggatgtgtggtcacataagaaaagatagaatacggaatgacgttatacaagagaagattgatttagtatccattggggaaaaatgatagaaaatcagttaaggtggtttggcatgtacaaagaaggtcacaagaggtgttagttagaataactaatttttcatgatatttagtccgagaaaaagaagagggagattgaaaagaaagttggaggaaatcatcaagaaagatcttaaacttaataatatttataaaattttgatttttaaccgtgtcgaattacatcatgtaatccatgtaaccgacctcacttagtgggataagactttattgttgtggtatcctaatctaatccagctttatatgtttccaaagcttattattattgatccatttggttggcatttcaaatgctattttttttttcttataagatacattacatgcagttgatgaagtcattattgaatatgaacttcccattaacttatgtatacattatttatcattaatcaaatactgtagaaaatgggccggggaaatagaagaagaaaaaatcattttaaagaatttgaaactgatggtttttgtgtcagattcctgcagagataagcaaatcaaatggaaacaatttgcttgtcaatgatgaatccaaatacaaatcaatgtggatccgtgcatactcatctctgtggatgctagcgagtgtctcactaatcatatacttgggtcatctttacatctgggccatggttgtggttatccaaatatttatggccagtgagctcttcaatctacttagaagagcaactcaagataaacgtctccctaagtttaagctcttgaactggtaagcattcatgtacggtaatttctaaatgattatttgcatatgagaaatgtttagtttaatatatagtgtttcacaaagatatgattctgaatgcaatgtccaggcattatttcttcacagcaatgctattcgtatatggccgtattctcagtcaacaacttgtgaatacagtgacttcagataaattcttgtatagatttgtgagcaacctgatcaagtatcagatggttatatgctactttttatatattgcaggttagtacttccaaatgttttattcataattgtcaccaaatttggtaagagagaaaacatgaataattataataaagatacctttaggtcctgtctttgttgggcatattcgtcataaatctgaatcaatcctgttacgtaacttaattttatctaatatcctgttaacctagtcttctgcaggttcaagtgtttgctgcctgtaatttcaaaaaaataatctttcattcttgaataagtcatttcatctgtgatttcaggttttgtatggtttattctttcattgaagaagagatattacaagtatcagtttggccagtatgcatggacacatatgatacttattgttgtgtttacccagtctgcgttcactgtagccaacatatttgcagggatattctggtaacatgacttctgttatattacttgatgatgaaatctccatcatctaattccttcttttggtttattttttcctattatatgtgattttagcttacttaaacatctttctaaatatgattctacgcaatctagcttcatttacatttgatcagaaaattgtagaacatagttacttacagaaaaggatacattaaatcaataaacaagaaatagtctcttaacaaattctttttaataatttgcatcttttttttttttttttttttctgttagctttctgcctttctctaattcttgttttcattccaacttactgtatggttgtggaaaaattatatttttgcatacatttaatgtattgaaaaaaatatgttcaattttttatatgttgactttgatattgttatggacatgagtaaaaggataatcagatataataagtggaattttagtggtctttgaattaactatgttgttgctcaaaaatattaaaaatgtttctattaaatttgtggtttgattgacttgtacaaagatttctcattattaaagaagaggaagaaaagaacacaaataacgggactctttataaacatggcatcatgattcatgaaatttacaatatgtctattgtttttgctcccaaagaggttcactttcctgcaaaactaccatctgtgtgtatcctcactcaatggaaattctgggttctaatacgagtaactgctttggtattgccaaccactatgtttttcatgctttaattgattttattttttctagttacaacctaacatattaatataatcatgcaaggtttcttttccctgcaatcctcattgctatgaatgatgttggtgcatattttttcggtttctattttgggagaacacctctgatcaagctttctccaaagaaaacatgggaaggtttcattggagcgtctgttgccactatgattgctgcatttacggtaaacatcagttagtgacatgactgacatcaactaccatcccaaaaagctttcaaaatttacaccttgtgtttaactcacaacctccactttcagttgatttaatgatatttttcagtatttttgctttgcatgatatgtcacttatgtttgtgcagtttgcaaacttcttgggtcgcttccagtggctaacatgtccaaggaaggtaacaatcttgattgggtgcagtcatctatgaggaaatatttatgctgttcctaatgatggtgaaataaattcaggatttatcaactggttggcttcagtgtgaccctgacccaatttttaagccagattacattccattgccaggactgatttctcattgggtaagtaccaaaaaattaaatctatcctaataattacaaagagatagcatttttgccactaagcttaagattaagaatttaagactaaagtttttcattttgcaacattttgtagcttccatggaaagagatagcagttttgccagtacagtggcatgccttgtggatgggactatttgcgtcaatcatagcaccatttggaggtttttttgctagtggcttcaaaagagcttttaaaatcaaagtatgttcttgctctttatactagacatttattttgcatccatcacctttttccattcactttgaaactcccaaacatagcaatagcattgatctctttgaatgattacaggactttggtgatagtatacctggacatggtggatttacagacagaatggactgccaggtttgctcatagatagatatttatgtactagaattatccttggtttatatctgaataggctattaattcagaatacacttttcaaattttttatggcattatagttagtcaataatcagtaactgctatgattgatcttgctttaagtatttgggggtattttctctgttttatatctaccgttttgttatcgatgagctaagatatcccattgtcttgacatgttaaagtgaaattgattcattactaataaaatttatatgccctcgctatatacaccttgtttcaatgctcagcgctttcaatttcaccataaatcatgagcggctttttatgccatgctataaagtacacaaataactctgcagctattgtgagagtctgtgactgttgtgttttatactgtgatgcatcctctgcagatggtaatggctgttttcgtctacatttaccatcaatcatttgttgtaggccaagactattcagttgagatgttattggatcaggtgagtctctagtttaagcaatttattggctaactttcattcatgtgaaaattagaggattctgttttctttcatttccaatattacacacataaatcaaactggatacatttcattatggtcattacccataggtgtaacgctcaagtgttttatttatgtagataatgaggaaccttggttcagaggagcagctatctctctacacaaaactcgggaagatattgcaagaaaggcatttatgataagttcactatacaattaatagagaatgcttcagttggtgttttatttgtagaagaagaccctgttggaacaagtggtggagattagtaaacaatctttttagacctctttttagctgctgaactatgttaagtagagtgtaccgatccttgcaagtgacattccttcttttcctttagggcttaacattgacactttaaagcagatttgtattgagaaatatattggtgtttttcaatactgctttttattagtgttatctactattgatttatcatcgaagtctcaatataaaaacttgtaatgcattattctattcttaatattctttcttcaaaattcaatcaagaaattttctcacaatttacatccgctgaaacaacacacattcaaatgaacatgcaatttcattttcctgatttgttttggctagtgctcatccctcacttagttatgtactgaacctttgcatgttctctcaaccattcaagcactttagctccttctagtatttcttgaaccttcacgaaagtaaaaaaaagatcagatcaattaatccgtaaaattaggaaagagagtttggcccaaaccacaaattaggaaagagagtttgttgactgttgtatatgcatataggaaacaatgaagcagccaaaacaataaacaacagtcaacaaactcagaagtatggcacaaacctgtcccttcacccgttcctcatcatattcttgattttgacgtttgaattcagcaatggaattctcaacctctttgacaaggtcctcagtagcaaactacaaaacatacaagcacaaatcattccaataagaaaaaacactcaccaattaggcagtttaattataatttataaagcaagtgatatgtgcaaaccaaaatattatttctcaatcacagaattgtggtggccctaatacccttgtaatctttttacaagtgggaaagattttgttgtcagcgtgacctgagcaaatatttagaatggaaacgtatcttaatcaaacatgctacctgcagattttcacgcctatatatatcaccaactgccagactctgttttatcaaatttgttatattttccttctgatgctcaagaaattcgttcacagccttcgagcttgacagagtcgccagctgctgctcatttagtttcatttttgcctgagagaggagttattattaatttttctttttttgcattaaatcacgaataaatgtaaaaatttggaatctaagtcgcctgattagcctgaaaatgatgcaacttgcaaccaatacctgtatttctaataggttggctccgtaaagctgccttccttgttcctcaaacaaggattgaggtatatcaatttctaccatctgaaaatgacaagatgcacagatattttgtgataaaatttacatactccaatgttttcttgcagcataaaattcattaaaagaattatgtgcaggaaagggccaaagagagggaatccaaatttaaaggtaacttgtttcataaatgtcagaatcagattttttctaaggatatacttaccaccatacttgatatgacatagatgatttacaagatacgttatgattcaaaatcaaccatgaggttcataaggaaaggtaggtcttgtcatcttattacagaaaattgaagtccttgataatcattatatgcctaccagaaaagcataataacaactctagtgtatccatgtcagatgcacataattatgcacaatgtataagcatgcatattgaaaacatgtggcaaggtatgttctaatctagaagacgagacaaaatcaatccaatacatctacttaatgtaatgttaccttagaaatctgatctaagatagcattatcagttgcttgttctctagctgtttgctccacctcttgacatttctgtaacaacaagtctttgacctggaaattcatgctagagaattttactctaaattcaactaaaaaataattccttaatttacttgacaatcgtacttaagggtaaaaaagtcacctgctccactgtggtgcatccagggagaagcttatcagcaatagaatcatccagctctggtaaatctctgtaaaaaagttctttgcattcaacctgttatacataaaaggtatttacaataatcaagatcagttatatatgcagccaaaggtgtgtttaagcaagctaaaaggaaatgatgagatccaaacatgcacctaatgttgtattcatgaaaatgagttgagcactgtgtacactatttagaaaatccagagtttgaatcctattcctattgagagaaaatatagtttaattttggcagagggataaactatcccctccaatggaaagcaagaaggcaatttagacaacattgcctgaaagttcaaaaactttccttctgagatgcctgttctcaagtttgaggtaaagggtgctaggctagagaggagtagtttcacgccaaaaacttttcacaacttctctatctaatgaatcactgattttggagtcttttgcctaggggcagctattctgcctacagacttctaaaaatatacaggataggtaaaaacttcacttcctttcctcaaccaacctatagtcgctgagatatgcacaatctggtttatgaactgaaagggattactagcttgactagcaaactggatgaaactctcaagatcatctagattattagaaaagtagatattcaaacaaagatttataactttcttattatttttatattaccaagcaaaagcatcatcacaagaaatagaatttttcataataaaatacagcagctactcgaatcattgcacaatcattttatatttatctgtagggatttgatttttgattttaggatcatgtatggaaaacactagaagacttctagctagatcacggttactgtatgatggggctacgactacacaagctgaacaagaaaggtaaagcttcatttcttgctttcatcctctttcttggaggtaaatgcaaagataaaagctggtattaaaatctgatggagcaacaaagctaggaccataaacatactaatgtaagaaaagaaagtgttaccccctcttttataaatcgaagacaataactctatcataaggagatgaaaaagcaccataaattgcatgagacatatggccaaaaagtatttattttgaagaatttggtatccaaaggaccaaaagaaaaaaactatcatgtcagatcatgtccctaaaacaattaaacttctttgattcagcattagaaacttacagtaaactgagcatgaacaccttgaagattttcttgcttccatgtttcaggaaatacaagaggaaaagactttgattcaccttgttgaattccaattatagaatcaaggaaacctggtaatactttttcaccatattctgtatcaaaattaaagcctgcatatccaatatagatttagaggaaatatgttcatgatgtactacaaaaagaaaaagacttgtatcgcttatcagtttattatcatccttcaagcacatcacccaacctttactttcagcagaaggaatacttttaacatttgattcatcttgatcaatggttgttgctgagatgtcgaggacaacaacatctccaacctgtgaacagcaaaaaaattgtagcagctggctaattttgggtagactagtcgaaattattaatacagatattaattatcaagataacaaaagtgtctgtatgacagttatttattagtatgagatagtaaagataacataaaaataatcagtaaatatccttcattgtatcagtcacaactaaatataaaacatacatgatgaaatctatatagtctgtgcttgctttaaagaacttggaagttttatgactaaaatgattcatgagagtttcaaatgaatagcatttctagtaaataatcattaaaaaattaaaaataaaaaagcaaatggttgtatgccagcagactggtataaattaaatttagtcacctgtagccctctgtcagtaaccactttcagtgcaccaatggacttataacgtcttctaaattcttgttcagatgctctgtgagcatctatatcactatctatctcaacaacaatctttaaatttttgtatgcattattatcgggaacccatttgatttctggtgcaatatcaacaaggacatcatatctggagattggagaagttaaataagtgagaatagttaatataatctgcctgtagaagtcgttggctttggctgacattctgacaatattagcattcttaatgatagtcttccttttctctatactatgtcagaatatagttttagtattacagatgcagcaaaggaagagaaaaataacgactctaatggaaaatatatttcaaaaagcttaacctatagattacctaagagacccaagagaagaatatgtctcctccatctcagaaaacttagtcactattcgtactgagtcctgcaaagcccttccagtaacctataaacaaagttaattaagaaatgctcaagtgtaagatcagaataatacttgatctaataatccactttattcagtaataaccttggagaaatgatcaggaaattataacgattttttttaatctgttgatcagtatcaagtcctcagatcaaaggcatttcagtggcacagattttaaataaatgcattattagatagcactgttaaatagacttaggtaacgaggaaaggtcatgaaccaataagcttgtctttcaataatgaagtaaaatttcaagatcagggaattattaacagatataattgcaagtaaacacaatgaatccaaaagtgtaaaaagaactaacatcaagagaaaaaaataaggacataaaaaataagaaaatagaaactatattgtaacataccgatgccatagcatgtgagagtgtcctcctcaatatagattcaatagtagccttctgaacattttgactcccaacataactaataagaatgctttctggaactttctttccagggcgaaatccagggatctgttgacttaaaacaatcgtaaattagctcataaagataacatgcagccctttggatgctgaaacctgggatccatgacaatctcaagtaaattcatatatgataggatagagcacatcccttaagattgtgaggtttagtaatccgaaattttcaatgagaggttttagttatagtttcaaatttagaaactgggaatcctcttgagtcttgacagacaaaataaagtgcaccgtattcacagacaacaataatttgatgcatatattttctttgagccagaatataagaaagacattacattatataattatataaagcataagtgtaaccccatagcacctttgcttgcttcataaactctgctatgaccctcttgtaacaatcctcacataccaatgatggcacgtccacatgcaatctaacctgcaaagggaaagagatgcaaaagtacatattcagtgatatgaattctggtccagaatatgtgctcacttgcttaccattatcttatttttaaggctttcttttgcaattgattaataatgcttgcatggaatttgaatcttctcctattgtttaagtaacaagatatggtcatgttgaagagaaaaatacaccttgcatatattttcacaattatcattaccctttataaattatatagcaaactacatatgattcacatatgattgttgagctgaaccaaactgagaaataaagataaaggaaaaaaaaaaaaaaaaaagaacatactctggaattgggttccgctgtttcagtgaccttcaattctgctggaagacggtcctgttctgtgccaactgaaactgaagaagaagaagaagcagcagctgagagtgtgaagggagaagaagtgtgaggagagaggaagggttggaagaggtgaatatgaggcgaaaaagatgagagtttaagggaattgaatttgaagggtgttttagtgttggcattagcacgaagaagaagagagtttgaagaggaagaagggttgaaaagaaggaaatttctgaaggtttgagtgcacacctccattgtctctcagcactcacagcagacagacacaacacagagcatgttgatcggataaaagatagatattgtctttttaagtgtttattttaaaatcaaaatgtaacaatttcagtaattttctggtggtcccaagtttcagagtttacactttacagttatagaatgtgtcaactgtcggataaccatgcgaggaagtttttttagaagacaaaaagtaataagcacattaaaaattgtgtacattttctaatgaataatataataaaagatacaatatagttgaggttacgataaaatatgatattaattttgttttttaaaaagttttatgttaatttgatcttgataaaaataaaaaaaaatatttttattggtaaatttcattagacactaataatatgtgattgacatatttatatttatacgtgtaacagatttttagcaagagcgttaactaaatatttgactttgataataagaaaggaatacattactctcttccattccaaaataattagtcttatattttaagtagatcaataaaaaataataaataattaaaagagaataataatttataaaattaaccttatattattattaattcatttataatttttattgtccattattaatattataaaggatataaataaaaataataataattaatattacattaaaaaattaaaataaaatttattttgaaacaaatttttattccaaattggtgttctacctcctacatttctcctagcataaagaccttttaacacgggctatcaaaactaatggttaatttcttctactcgtacggaacaatcaaacaaaagaagcatgcatctttttctttctttcttttttctttttttccactctttctatttttatgcattcaacaaaaaaaaaaaaaaaactctttctatttttattcttaccaaacatagaataaaaagtaatgagaatacgtacaaaagtaatcttatattattgtattatactatttgtttatctttcaaatatttaaactaggaacgttttctcctccgctaagatgaattagttaagtggcaagacattaattttgaatacattaaattaattgtccaagcagactgttcaatttttttttcgcctagctcttttatctcccttataaagtctaatgtactttttgaacaaaacaagattaagaaatattgtgttctttaaatttttaggatattttatgcctttatattgagttttttttctttaaaaaattcactttgagtttagatttatccgaacatggaattgatttaattaactattgttggatatatagatgagaaaatgttttctttttaaatactctacaacacgaagagttccttaaaacaagtatttcgattagattaatattttaaaatcctcctttaaaagtaacattgtctaagtaattgtccgaattattaaataaaatgttttttttataagcgaaaattattattagaagaaaggcaccagtgtacagaatatgagctacacgagtatcattacaacaaaatcctataccccgagaaggattccaccagcacagaagaagtactagtaattaaagatagagtgattataaatcattaaataaagtggtgttaagtgcttatataattaattatgtttatttttcatttaatagttttttaaaatattagaagaattatgatgaaaagatcatagaaaaagatatatcactgttgtctcaattaacattgaactcagtatctaacataaaccagtgaaatattattataaaccactagaaagaaaaatagtgaaacgcaatgacgcatgcggcatgcaggccatgcatgttggacttatttagtgagttagggatcccaagggaagttgtatgcatacgttttccatgttatcgttcactccggacgaggaggaggaggaggaagagcaggagcaggaggaaaagtgtaacctgaaaagcacggcttcatatatagtatgagtcctctctcaataccaaagaaaaacaaaaattcaggaaataagcttccatgcatacaccaaatcattgaaagttcaatcaggagaagaagtactaatgtgtcttggatgattcacatcttaggatcgtgtcggtgagcacattaaactatctatctatccatgtcattgagagtcctcacaatttggacccaatgacacagtcatcaggggcaggcgtgctctatcactaacctaataggtcgtcctgggtgcattcaggtgaagaatattgtttaaaagacttctcgctatgcgaaagaatattattaagaatatgttaatcaattcttttaacgcatgcaccttttctaagttaatagaattttctatattactaattaagaaagcagagtaaggagtacggatgatagaaaacttacttccgcagggaatgtcagcaccttctagggcttggcagcaggcttctgatggcggttcctttggcccaatgtgaatgtgtgacacaaacctgccacaattgaatgcaattgccctattatcaccgcattcaaatggtgtcggtggtgttcctaataatatgccttcagtttctgtttcagctgagatgccaccaagcaccaacattgcaaacactaagctccctctaattcccatcctcacacttaatttcaacttctttctaatccaaaatcaactttgctcacaaattggattgatgacagattattatgctaacaaccctacaattgacatcacgtatttatacaagaaacaaaaggaagccattttttaataaaataaaataacttgtggcgttaaccaactccaagtttatttccttatggttattaaaatgtgattaattaaaaagctgactttctttttaaccatacctgaaccgatacgtttcaatttgggattctttttactccctttctttctcaccttttcgacggccaattttttgaagaaaaaaaggtaacgtgataaaataacatattttattttagaataaattgtaataaagttactcgagaatacaaattatagcaatgtatagtagtcaaataaaaacatttcgtaacacattttactttttttcatcatgttggatttagaattaattctcatttatctactttatacagtgaaaaaaaagtttgtattcaactacaacgtttattttatacactatgaaaagttatgatattttagtattgtaaatttggatatgagtttctatagctctaatgaaaataatattttatatcaggtttcttattgtttctactgacaaatcaccaattattttgataattttttatttttaaatcaagacatttattttttattctttagaataagtaattttggttcttccatcaaattgataattaattaaccatctaaagtcaaacattggttttgatgtgtcatattggtgtttaggtaatgtttatgtaaataattgacataataattatgagataagaaattaaataaaatgaaaaataaaaaagattttgacagaaattaaacttataaccttttattttaaatataagatattaaatcattaaaatatttattttatttagtttaattttataaacactattcccatcattagttaagagatattaattttttgaattaaaacaatttaatatataaatatttttaattatattttaaatcattttatatattttaattttaattttaccaatttataactaaatttcataaattaacatataaattatttttcaaatttattttaatacaaattatttttactctaattatataaattgatataattacatcaattaatatgtaaatcatagaaatcacataaatttaatttaatatgtaaattatttttattttaattatataattagtaaaattttaatttttaattttttaggaaacttacatgttaatatttttattttaactatataaattatttagttaataattttttaataccaactatataaattaataaaattacataaattaataagtgaattatttataaaaattattttatataatttagaaaaattattagacttcatttttatatataaataatacaaattttattttaattataaaattaataaatttttaattatttaaatattattttaagtttacataaattttataaattacataaaataatttttttgaataatccatacattaatttgtgtaattgttttaaaattataattaataagaaatttttttatatatattataatttataatttatatgaaaataaattttattataaaaataaagacatatgaaattaaatgcataatgcatttaaatatttaaatattttattttaatttaaaaaattataattcaaaattagtagctctttattaattatacatgtaaaatttataaaattaattaaataaaacaaagtatttttaaatttcattgcttgatatttaaataagcaacaaaaaataaaaaaataaaaatcacagatttcaaatttcaaattataaagataccaaaattatatattaacctttattttattaaactcacattttaattaagacacccatgtttgaattttagttccttgcacgggcacggcatttggtttaaacttctttaattgagcttcgggttcaaaatatttctatattattttataatttatataaaataaatgctagttgacgtctatttaaagaattatcaatatatatatatatatatatatatatatatatatacacacgatcatgaatgttgatatatattaaaataattatacatttacaaatatatatcttatatagcttactttatttaaatgtgtgtatgcaataaatattagtttttgtcaatatagttatgcattcaaaatgtgtaatatatatatatatatatatatatatataaagtttttaaaagtaatttaaaagttcttatagcttttattaaacctttacggtcatcgctcgcatcaatgaatctctttcgatatcgtttgacaaatgactccataattaaccttaattatataacagcacaaaaatctacccattatttcccttgggtatacaaactaattaatttcataacaaacaaaaataaagaacttatctttctttacatactagttggtgtacttgggataatccttcttcatatgttaaccttttcactggtgcagcaaataaattcctcatcttactctttatatatatatatatatatatatatatatatatatatatatatatatatattacacatgtaactatatttattttttgaatgcataactatattgataaaaactaatatttcttgcatacacacatttaaataaagtaagctatataagatatatatatatatatatttgtaaatatataattatttgaatatatatcaacattcatgatcgatatcgtatgtatatatatatatatattgataattctttaaatagacgtcaactagcattttttatataaattataaaataatatagaaatatttagaacccaaatttatattttttttaatgagaacaatcttttaaaatatcctcaagtgtcttgtttctttttattttttgaatgatctagtttgattatagtgtcataaaaaagaacgatctaatttgatctaccattacaaaaaaaaaatgacatgatttgatatatatagcattattaaaaaataaagttctgtttgagttttttataattagaatgagttaatttgtctaattccatgtaactgagaatcaattaattcctttcaaacattataatttatacataacttcacaagtaaccttacataaccttacatacacagtagcataagaatgtacctattattgtccttggatatacaaactaattaatttcataacaaacaaaagtaaagagttgacccttcttcacacgctagttgcaacccttcatatgtcaaccttttacatgtgcacaaataaatttctcatcttgctcttttatattttattcgaacgaaaacaacctttcccaatatcctcagtgtcttgcttcttttattttttgaatgacctaatttggttcagaatgtcataagaaaaaatgacctaatttgatctagcattacaaatgatataatttgatatagcaccatgaaaaataaagttttgtttgagtttttttttttttttatagtttgaatgagtcaatttgtctaattccatgtaattgagaataacctcaactgattccttccaaacattataatttatatatgacttcacaagtaaccttacatacacaatagcacaagaatctacccattattgtccttgggtatacaaactaattaatttcataacaaacaaaagtaaagagttgattcttcttcacacactagttgttgtacttggggtaacccttcatatgtcaaccttttacatgtgcataaataaatttctcatcttgctcttttatattttattcgaacgaaaacaacctttcacaatatcctcagtgtcttgcttcttttatttttgaatgacctaatttgattcagaatgtcataagaaaaaatgacctaatttgatctagcattacaaatgatatgatttgatatagcaccatgaaaataaagtttttgtttgagtttttttatagtttgaatgagtcaatttgtctaatttcatgtaattgagaataacctcaactgattccttccaaacattataatttatacatgacttcacaagtaaccttacatacacggtagcacaagaatctatccgttattgtccttgggtatacaaactaattaatttcataacaaacaaaagtaaagagttgatccttcttcgcacactagttactgtacttggggcaacccttcatatgtcaaccttttacatgtgcacaaataaatttctcatcttgctcttttgtatttttttgaatgagaacaacctttcacaatatcttcaagtgtcttgcttcttttattttttgaatgaccttatttgattcagagtgtcataagaaaaaatgacctaatttgatctagtattacaaatgttatgatttgatatagcaccatgaaaaatgaaattctatttgagtttttcatagttagaatgagtcgatttgtctaatttcatacaattgagaacaatctcaattgattcctttcaaactataaaactatgacctccttattactctaatccctatgcccctctttccaatccctatgcatgtcttgtcgaacattggttataaattgaacactattattcacaaaaacgaaattgtttaacggaatgaaatataagaaattcatataattgtaacttttcaaatttataaaaaattgatgtctactgggagcaattgcacaaagattttggagataacaactcatatggcacatacatactgaaatattttataggtatcatgcacataggagcatgcataacttcctttttgttgaattaatgtagatatcttttgcattgatgaaccaaaacattaaaaataatgctgacttagaaagtgtattcatggaggaaccaaaaaattaaagcaacaagtgaaaaggcccatgtgacatcaattcaaatggtcacaatctgttcatacatcaaaacattcagatttacctttcctagaaccacacagcaatcactgatcaagtatcgggtaggagcattatctgttgcatctactattatatcatatctaccaaattcacataattacaaagaaaaaaaaaatagtcagtggtaatataaaaaatgaaatgtaaaatgtaagtatagaagaaagaggcctcaagcaaaaagaaaaatcaatcttattatagaaattatacttgctgagaatttccaaagcgttggaagtccgcaaagcttcttcatgttccacaacttgaatagtggagttgatcctaatattcaaaatatcttagttccaagaacaatgatgatacaaatattacaataacaaacatttgaaaaagaaaatttctcatgggattttatttgcagtttgtcaacaaaaattgatgtgatgaatggttggtgaaaaagtaacctacgagcgacaagcagcagcagcagatttcactttcggcttaccaacatatgcttccgtgtggataacctgaaataaagcaccaacttgtccaaattaataaaaatagtgaagttaattaaaaaaatagtaaacgaaacacaaacactgaagcaagacacatattaacacctttactcgcaaaagtgcaaatgcccaaaggctgatgccagacacaaacacaacaattcacaatgtacgtgttgtaccggctatgccaaaagagggtgggaaggtaaaacagataatacaatacctgcctatgcatattattcagctcaactacgtcatggtcaataacacccaagcgccctgagtatagtttttaaaatgtaagtttcaagaagcatatagactgaggtattattacatattccttttgtcaagaaacatatataacatatatacctagacacaacaactaattaggatacctcatagctcttatcgtccatagtttccaatgccgcatcttctttcgttgatctattgacaccagtatcattcttcgtaagaagatctgagctggtctataaattaacacaacaagaacataattaggtgcccatatatataattaaggtaaaattacaattattaaatctaaggaaatatttaaatgtgagtttggctacatatatagtacatacatcaacatgaaggtcctctacactttgatgatcatcatcaatatcatcatcttcactctcctttctcttctgagcaaaatcaagctcatccatgacaagtggtgtccttctaaacgacatgactggatcagaagaaaaattttacaggtattattacatattccttttgtcactcttggctttcttttgcttttttgtttttttatctttcttgtctttttatattttttatgaatgaatagccccataaatactgactaatattttgtttcttgaataccttgtttgtttcaaatccccattttatgtatagtcttgaaaatttggttgtactttgacgcattttggtttgtttaaaaaacaattttcaaaacttaatagattttagatgatatatacattgttgagtagtgtaatttttttattataaaaagagagaattaaacatgctcctaatttatttatttttagtttttttttttctcaatgaagaggtgcttctttgacctttgttgcccaccactcactaggatttttttttcttccaggaaatagtttcagcatacccttttatttcacctccaggcctgactcaagcacactcaaatcgagtgtcaaagctcttgttcttcttcaggtccgctcacatatactttgtctggtctttttctccttttcttcaatgctttcttactaacacatatcttttgctctcatggatatcttacagtgtggcatctcaccccgatataaggatggattcctccatggtaatgatatttttcttattcacctgaaggaccgtgaacttctgtttggtaaataatattatttatgataaatagtatctttgaaaatttggtcttcaactgagtcaaacggcattgcatgattcatgtatttttgtggttgatgttgttcccaaactttgcttttgtacggtatatgttcaatacatataaaatgattgttgatatcttatcatctcctagatatatttttcctttttttctcactaataaattttcttttgcatttatttaaaattgttataagatattgtaaaagcaaccaattgcaaccaatttaaaaataagaaataatttgttaaactataaaatttcataaaagatgattaaaattgttataagttttcttttgcatttatttctctcctatttcttttaccattcttttttttatcttattttcttttatttttattttattttctctttttcttctccttctccttcctctttttttctttttaactttcttgtatttatcattaagttcatctattatcaacttccaattaatttggattaaatgtaatggtcaaaagaccatacatacataatctaaaatgttttctgcctataaaacagaatcatgcagtcaatttttatgtgcaacttgctctctctctatcttatcataagacttctactttatcttacttgaaaatgaagtttctctctctttcaatttataggtcataccacttgttcttctttcttagcattcagtcatacttatattttttttactgccaatatactttcataagcatccatggacagaaacttttgggcaattgaaaggcatattagttgttcttttgttaatataaaattaaggagattgctttgacattaccatatccgtttcagcagggtttttgctcattgaaactaacactttaaggaaaaagatatgactctgttcactctttacacttacctttttctcatctgcagctcgtatacctctatatatgtatcccttgcttaatacaaccagtatggccaatccatttgagaatatgaggcttaccagtcttggagtcattggtgccttagtgaaggtactacgtccttgctgattctgttattgaatacactagactatgagaagaataattttttatacaacatttatgctgaacagagaataatttcaattagtaaattattgtcacaataaaccctgccataaaaaactaaatactacaataacctcaagtaatatgtcatttaaaaaacagtaataactgattattgattattataaatctgtggcacacaggtaaatgtgtaaatattttagttgccacaaataattagtcttgttataatcttataatgttcatgtagattttcaactatttgttaagtttcaaattcattcctgtaataattttctatgatgtaacaggtacatacaactcaacttgttcggattagttcatcgctagtatcagggaacaaaattttccgaactattttatgcccttcaagatattgttgattttttttcctagtgggatgaagctattgtttttttttttttctgttgcttgtcacatgtacatttatacttgagttttgtcatgtgtttaatttcctttctgttgatatttcaccagtttcataatacagcagctataagtttccttctttcaacagtttcttccgctttgcctgcatagtatgcaaataggcggtgaattgtcaaaaactgtaagtttactgatcttgttttaaaccaatttggttcgataaaatatttatttggatgaattaaacttgatttttatttgtttcatttttctgagttacattttttgggtatgtatgatgaacatgtatgcatgtgaagcatgttccaatacaatgctacataggaggtgtaaggcaattagcataccatttatctgatcaatgagattacaactgaggaaagtggtcttggcataagataaatggatactatgtgaacttggggagggatatcatttaagaactctctttttttcatcttttgaactgttggtcttaatataagtttttttagtggttatcacaggactgttgaaactcttcttgacatatttggttgtagaagagtgctagcaatactccttttaacattctattattggttgaaatttgttgaaaatcacaaattttggtaagttccacttttaaattaggacagagactcatcaaaccagaagtaaaaaccactattataattttcaataaatttaaactaataaaaaaaagaattttaagagattttaagagagtgttgcaaacattcctgttggttgtatcaaaatgcaactcgacaccagtatttgtagttacatgggttgaaataccccgtccttgatacttgagatctaaatctttaaataacacgtttgtttaactcttgcgttgtagttggtggtgcatcgtaaatgttaagccacgtgtttgtttttgccactatctcgtgatcctctttttatgctatcaaaataattgtaatgggaaaatttgtgtgtaatctaatggaagttccaccaactgcaggttggaacctttatagttgaacaaattctgtcggttgaaaatggtatgaaacatatttgtacttcagcagggcgcctttttcaagtatatatagttttcggaacgatggtggtaactcttgttcagcaaccttcatgtcgtcttttgaaggtcattattcgttgttatcttcgtctgtcagaaaatcagaggtttgttaagtagatagtaactccagttttataagtgcttctgcagttctgccaatgccctttacgttcttcccaagtttctaataaaactttggtcatttcaaaatagagcttgtcatgcattaagaacctgtcttccagccgtgttaagagaagctacattcagtagttgccttcgtgtaagtgatattattagtataaaaatttgatttaatcaataagattgaagtgagttgattaagtgaattgaagattaacaatagggcattaacttgtaaagctcgctctcttcaaatttccgagctaaagatttttctcctcttcttatgaagagattattcatggttttaggatgtttacatttttttatgattttggttttatttattcaggaacacccaacagctaggagatggctacagtagttgcttcataatattagagtcaatccggttcttgcacaacaaggtggaggaggatccgatcatatgacggggtcgtgagaacaagactttctggggtttctacatacataaaataggattttcagttgggcatgtatagagagaatgaagaattgaatgggaagggaactatctttccgtttgatgtagtgaaatatacatgagctgatgagcatagtcacctcttaattaaatgcaaatattaaaatcataatgagccatatatttcaaaaataaaaaacttctcttcatctatatggataaaggagattgttagagattaaatataatgagagtaaaataattattcatttttttcttttaaataatagcatgtaaattttgttccatgctattataatatatgcaaccaatagactggaaattttattccattatattccactttatctcattctatttcttttcatcaatccaaacaagtccaaaactcaccaagataagagtaaggaaccaatttgatcattcagttgaccaatagaagaatctcaatcaaaacccattgaaacctcgttgatcaaatcagacctaaacacacaatataaaacatccaagaacatacacacagccaatcatgaactaaaaatgagaaaatagattgaggttttaggatcttaggtaccaatgagtggtccagattcactctccatctaaacataaatttgagcttctagattttaaataattaaagaataggaaaaagtcaacccttcacaaattgacagatgtcgcaagaaggttcaaaattgatttcatatgaatctgaaaaaattgtccaagaagaaaaaaaaaaaccttgatttcatatgccaagctgcactatggtctaaacaataagccaattacaacataagatggaagacaccaatttattattattagtaacaaatttaagtataatcaaatttatatatgtatatgaaattttagatagtgtcaaattttaagtaatattaaattttattttaaggtagtgtcaaattttatttttaatcataattaattatataagtatatataattattgataaaaatcccccactaaataactccaattttatttcaaattttatcttatatattgtgtcatgttgcgacaatatagctccgccacttatagttaaatttcaacaccattctctcctacagatatttaccatgctgtaagccccaaatcatcgaggaagcagcagagttttgtgcatccttcaccctagattcttcaaatgttagggatgaaaaatctagggtgaaggatgcacaaaactttgcaagatccttttgagaaaaagaggaggcaacaaacaccttagcaacacttgcatgtccttcccttaattgttttatatcaacctgcttcgccttcttttggcacatctcatacaacatagtcactattggctccaaaacacccctcacaatcacaattattttcacaaaccaatttttcatcatcttgaatttatacaacaacttcaatgtaaaagtaaaagcttattataaaaatcatttataatagttgtcattcattttcatcataatgaattgattcagcattgcaaatgaaattaaaaaccttgcctgataatcaattataatacttatcattcttatcctatttttgatacaatattaaaaaatattatatactatatttgaatgcaatcttaaaaaatattttatcttattatgtaatgtaattttaaagatttctattatattatgtaatgcaatttctaaaatattttatcctatttttaatgtaatattaaaaaatattatatcctattatattatgtaatataatcttttttattattaaattacttttttaatttttaatatatataataaaatttatattaataaaatttgggggtggcccatcctaacctccctatctcctcccctttccgcaagtcactctcaccctgtctcacttcattccaagtccggtccttcccgattttcttttataaccaagtcaaattccttttagaagtgcgtgtttggataggtaggtcagtagacggtcacaacatcttgctctcattgagtaggtgggtcacgacatcttggttgctctcattgagtaagtgggtcacgacatcttgctctcattgagtaggtgggacacgacatcttcttgctctcattgtatataactactcaagacatctttttgtagcaaaggcattaaaataaaaaataatagaacaatctaaagaaaaaaaatgataaaataatcaaggataacaagactaaaaattatcaataatatttttagaaagaatatttgtttgtcttaatcataactttttgaagcacaagcagggaaataaagccaagaacaaaccagagccagaagcaaaagcctaatatatatgttatatatatatatatatgtgtgtgtgtgtgtatgcgggtatctatgcatgaacattacagcacgcgtcgaatatattgcctcaataatgtgttcttttttttttttggatacaataataatatgattgaattttttaattgaaaaaatgaagtagacattcacttgtgcttgtgggatagtaatttattttccttttaggttgtttcattattatatcgaacaaagaagacgagttaagaatatatatatatatatatataaagaccacttaatatatgtccttattaatatctttttatttatattaaaattacttcttaatttatttatgttttttatctgttatttttattaattttttcactcttttataagaaatgatacttttaattagtcttccaaatattttataaataataaatttatttaatatttaaaaatagaaaaaatatttaataaaaaaaactagaaaatcagtatgaagatgttacatgaaattataattaatttaaaaaaatgtgttttgctatctccttgtttaagaaattatatcatttcttcgtaataagtttttgtgcgtgtatcatattaaagttcgaacctagttacggctatgaccttatgtgtattatccaaatctgtcaccactagtctttgtaacaagtgtatcacatgatcttttgaaagaaattatttctttcttttgataaacttacaataagaaaatatgtaatttaaatatttagaacaaattcatatgtttagaatagatctaaaatgaaatagatgtatttagaaattagttgttttaaaagaattctccttaaatatacaatacacatcacattctatttttattttaaaattgaatcaattttgtaagtttaaaaaatacagggatttctcaatgggtaatgttatttcaatacctaaccaaagaacaactacattaccaatagaaaagatagtcgtcattactatagtggaattttggaatttattaacattatctaaaaaggatatcgttaataatcttataggtatggaaactattaaaagaacaccttattgagcactctacaaagcatttgaagtatgagaaagaaatattgttcagataatatttctaaggagttgcaaatggatcaatgagttccccaatcatggatggttctaaaacggctaagttcatgacaatactatctatagttattaaatataaaagattgttggaccatgcatgttctccgtaatgattatgactcatttccttagtcaatttagctcttaatataagatcattcaaaatatactttttattcgtgaaaattgataagtataaaaaaatttacgataactcaaagactctatttaatcaaatgaactaaacccctttacataaatcaataaaacatttgaaagatttgttttatcatttgtcctaacaaatgtaaattatcagcaaatatctaaatgatcattgttaaaagataaataaagataatttattaaaaattaaaatcatcatgtgactattaattaatttttaatcttaattatttaacattatatgactcaaatttatatattttattcttaaatgtttacactaaatatttccccttcaacctttttcatttcataacatattttttatatcattttttattattttttaatttccttttatatatccgtatcaatatttattttttcaattaacctcaactgattccttccaaacattataatttatacatgacttcacaagtaaccttacatacacggtagcacaagaatctacccgttattgtccttgggtatacaaactaattaattttataacaaacaaaagtaaagtgttgatccttcttcacacactgttgctctacttggggcaacccttatatgtcaaccttttacatgtgcacaaataaatttctcatcttgctcttttgtatttttttaatgagaacaaccttttacaatatcctcaagtgtcttgcttcttttattttttgaatgaccttatttgattcagagtgtcataagaaaaaatgacctaatttgatttagtattacaaatgttatgatttgatatagcaccatgaaaaatgaagttctatttgagtttttcataattagaatgagtcgatttgtctaatttcatataattgagaacaatctcaattgattcctttcaaactataaaattatgacctccttattactctaatccctatgcccctctttccaatccctatgcatgtcttgtcaaacattggttataaattgaacactctattattcacaaaaaaaattagtcccaataattatcacacaattactattacattgcatgaaattatttgattaaatttaatttatcaatgaacagagtataatttgtatgaataataattttaagttaaatctatataaatttgatcaaattcacgtgcattacaaagtttactttgatattacatattttttcaattattccaaaaaaaacactaaataatttaattaaaccaggaggtcttaatacacaagtttatcgtttatgtgcaaacccataaaaattatgtgtatatcatcacttaacttacatgaccgcctaacagtccttggatgagagaaatatttcggaaactgtttttaacttcaaccctcaaatctttccgtacataaaggttgattaaaaaaataaaacttcaatcgtatgtactaatgaaccgcataatcaagaaaacaaataacgttgtcaacaatcacaaatctgtcatattctaattcgtaaatactttgatgtgccgtatattagccccaataaaaaaacgttaaacgtgtactgcatgttttgaaaattatcgacgattgtgcgatcaaccattgtcatttgtctgaatcataaatcccagaaaacaactttcatttctcaacgatccctaatagtaatatataaatttctcgctacgccatttgcaacgatgaccatcatttacctttcatagacaaattaataatatacgtactaccatttaatctttagatagtgaattccaatcaggcctaaagccttcactgttccttattatatatatatatatatatatatatatatatatatatatatatatattagccggccaatactccatagctatggtgaatactatgaatataaatgtaataaaggtattaatacataaataagatgaagaagacggttacggaagaaaaatatcaagagaaaattgtgggtttcatttatttatttattgaaaatattagtgtttttttattttagaggttgaaattatttgtttttattttattaattgtaagtttataattggttgtgtgtaaggatatgagatgtaattgggtttgtgtccaagaatacatgaggtgaatatgatcaatttaacagtaaaaaaccctaccttttataatttaaccttaacaaaaataaacgcaataactatattttctccattactaattataagatgatttcaactaaattatattcattagaaaaagtagttaatcataataaatgtgtcaattatacttttattatcattttaaaatgatttttttcttatttttctatctacttaattatttcttattaatgtttggaaagagaataattaaatgaaaagtatgtaaagaaaaaataataaatatatcttgaaattagaaaaggatcttatgaaaatggacaaacaaatttttaaaaagtagcttataattaaagatgaaaggagtaattttaagaatattgaataaagtgataagaaaaaagaatcttggataaacaattaacctctttggttgttatttaatttattttcggttttatatatttaatatctattggtgcttatagaaattagggtgaagggttgcatgagcttagtctcggtatgcaaattgaaaagtactggagatgttggattaatacatgagaaaaaaaaaatcttttaataaataacttaaaaaatatttactatataacatgaatagctccttaaaacaaatatttcgataagttcaatattttaaaatactccatacattaacattctccgagtaattatctgaattatcaaatagaattgtattaagtattcaatttatttattcatataataatttaaaagaaaattaaaatcatgggatgatatatcactgctatctgaattaacattgagctcggtgtcatacataaaccagtgaaagatatttatttattgtaaaccgaaaaagaaaaacacaatatattggacgcaatgacgcatgcaggccatgtttggcattatttagttatttatggatcccaaggtaagggaagttgtatacttgtatgcatacgtcttcaatgttgacgttcacagcagacgagaagtagcagtgtaatctgaaaaacatggcttaatagtattagtcgtctcaataataataaaaaacaagaaattaggttgcatactgcaaagctttgaaaataagcagagaatattgttgtttatgatctgggtatatattataagaagtaaaaaaattataatatcatccgattaacataaattgtcgaaaatgattaaattattaatattataataattactttagaaattaaatatgtttatgggggagtacttaatttctttttgttgagcccgttaaaatttagatttaaatgcatttttatctcaaatatcataattgtgtgatttgatttctcaatttggacatgatatttgataatatgatgatgtgatgtgtgaaaatataaaaaaaaaactgacaaaatgaaaaggataaagattataactctcaatcaaaattccaaaaaaaataatacttaccacaataaattaatagattttttcatatataaatgaaagttatataaatacaaatataccttcaataaaaatcaaaattgcacatatattacttatatatatatatatatatatataatttctagtattaacaataatatctttgattaatcttcttttgacatattcatatttgcatgcaatatatttctatttattaaattattaataaatttctaatacaatactaataataatagtattaattaatatatatatctgtattattattattattattattaatatatttagtatatataacctttctgtttagtaataataaatacatgtgcaaatttgatttcatttaaagtaactctcatctatatattagaaaattttattactttagtagtttggtattacgtactattggagcttagggttgaggataattctaagctcatcttggatattttgaaaaaaatgatcctcttatttttacatgtcatgttacaaattacgaacatataattaagcatttataacatcagcctcatatcaatttcaggcgttgtacatcatcggtatagttaaggatcaaaaatcgcaagaagtgcatatatactaataaagcctaaaaagttgtatgtatatttaaggtaaaatgtgttacgtgcatgaagtcaaatagctaggagagggtacgtgacatacatgcataagaattaaaggtgttgttagaagaatggttaaaaaattgaaaggaaaaatatttattaaaaagttcataaaagagcataaaaaatcataaaaatattttatacatttcaataaaaatatatttcttaaattcttgaactaatacagtaaagatattagtatttttgaagaattaattaagaaaagagggaaagatatatatacatacttccgcagcgggttccgggaggaactgattttccacaagacctgaggacatagacaattttttctccgctgaagtatgactgaaaattgccggcaatttggcacatgcaagggacatcaacatctttcagggtgttgcagcaggctgcagatggcggaatcattggcccttggggttcatagtacttctggcattcccgttgaatactaaaaaaaattaccattgcaagcttgacccgatatacgtggcacacctacaatgccagcaaccaccaacattatcgaaaaccctaatctaattccctgcatcctcacactcacactaaccacttcaatggaggattaattatatatgcttgcaattgtggagttgggatcacacactcatatatatagaagaaacagaagggagttattaaattctgattaattcaatatttgactttcttttaacccaaagctgaaaggatacgtttccttaccttttcctcggctaatctcatgaggaaaaaattaaaggtaattttaattaacgtgatattaaaaatctaatgggaaaaagagtatcatacgtctggtgtgggtctgtggttatatgtgtgtgtgtgtgtgagtgtgtaaaatgatcattacattacaaaaagaaaaactatatcgtaaatataaaatttatcgaatggaccaactaatcaaaaatcaatatttatatgatatttaaaataatattataaaattaataaatttataataatttatgtttaaataatactacctctagctaattcttattataaagtctaaattaaatcatttttaaaagatccaatctaatatgttacttgcattaattgtttttcacaaaatattcttaattaaaatcaatgcttgaatgatgtaaaagtgagaaaaaaaaaaatatatatatatatatatatatataaaactgattaatgtttgtaagtttttatcactagagaagttacaaaataatttaagagaaatttaacactctcaattaaattaactattttatataataattttttaactcgtatataagttaaaataattaattttatattaattaaaaaaatagtttacatcataaaaagagtcatcaaaaataaaattaaaattaaataaagaatgttttagaataataatattaaatataataaaattcattaaatttacttatatttaagtctattatataagataattttttgtttataaatgagtccatagtaagtactaattttattcttatttatatgattcaattatttaattcaccagaattaagaaaatatttaaattaatgatgtttatatttggattccttacacgtaggggcacggcattggtttaaattaattaattgagctcgggtccaattatttattcattaattttttctacctttttcacgtgcggtaaagtttgccatacgttttaactagttcaataattaaattactagttggtctttggactatttagaaatttttaagtaaatctctattattattctattttgttgatttattatttttcatcttaaaaaaggagctaagttaagaagaaacatgattatatatatatatatatatatatatatattattctattttgttgatttagtatattattattagtattattattattattattattattattattattataatagtagtaaattaaatgtttaatgttaattgcctcattgatttttatttttttttataatttagatgaatgtgctctgttcgtcgtatcgtaccatcgtgttgatgaaagcacagactattttgcatatgcctaatgttagggtgcccatctataactagagtatgattttcagtagattattaaaagcatttcctactcaataacccaatttttttaatggacctattgccatataagatttaattaaaataattcaccaattttgactccaatgttatcattcaacttaaattcttaattatttagaacaagcctctaattaaccacacatcattattttctgttaagctccttatagttcatagttgcaagaacacacaaatggcagcgtatcaaataagaatagttctcattttaagaatttgaaaagtataaatatatattactcaaccaaatataaatggccaaaattataattcaatttgtggtcacaaaaccacttaaaaaatcatgtgcagtttttttaatcttcaccacttaaatatatatatatatatatatatatatcaatatttggaatttttattttcataatatgaagtgttctcatctgatacatcctctctctttctatacataaaaggattaacggattttctctatttttttctctacatctataaatatatatacacaaatatacaagtttttaagaaaatatatgttagtctttataatgggtgaattatctttcatttatttatttaccaaaaaacttatgaaatggaggaaaagaaaacaagagagtcctaactaataaaaatacatatctagtgaaagaacttttatgaaaacatatcaagatatataaaaatggatcacaaatcacaattacacatgactattttagaaggtcacatgacttttttttatctatattttcatttcgattcatattaaaaagtgtttgtgagagtattttaaaaaacttataaaaatatcttccaattggtctaaaatatttcttaactttttttcataaacttttaaaataatttactagagtagcataggagcagcttattggaaggcacacctatgaatcatgttagacacatttatagaggcataaatgtattttttttatacatattatccttttttacatatttatttttcatgttaagcatcgatctttaaatgctgattttttttttgtttttatttgatttttcatatacttatattatttatttatacaagtgaattgtaaatttttaagctgattgatcatgattttactatatatacgattttaatttaacgtcttaatttatattttaatcatgttatgattattaaatatttgaattgttttaaaactactgataagtatatgattttttttaacacttatagcaaaaaataaaaacagactaatagcattcgcattgtaatcttgatgtggtttttctctttgttaaggatatcctctgacaaagcaaagacatagttatttaattacttgcttagttgatttcttaatttatattattttattcagtttttatgtccaccttatgtatattaaatttttttaaagaggtattataaatttattgattactatagattttgagtataggtaattaagatgataacattagtgttattgcatgattccataatcttatcattcaaagaattataacaaaatataattatatcttgtaagtaattggtaaagttatgatgatagcttgttaccaaaaaaatataaaacaaaatgaatcaggccatgagccatgtcaggtaaataaatgtaaaacccagaaaagaaaacccaacaaactgtgacttattttaaataaaacattataatactccaaaaatattttttaaataattcaaataattttagtacattatcaatcaattaaatgattttgaatataattttgaaatggttacgacaaaaatcagcaattttatcatacacaattatttatgaattatgattaaatactattaagaaaattgtttcactcagtttttcttttgtaagtaaaaaagttaaactaaaaaactataggaaaacacattaaatatttgcattataaaataataaatacgaatgccttgagatatttaattttatctgtagctttaaagtataatattatgaatatatgaatataatttaatgattagaaaatatttcgccttagttcaaggattagaatatatgcattcaaaaaaataatttaagaatgtttccttgaaattgaatattataaatatagtaaaatgtaacaaaatattccttatttaaggatcttgttaatgaataaagtaagaatattttcctgaatattatattttaagtaaaaagataaactcaaaaactcaaatatattttcttttttttgaatagtcaaacatctatctaaatgttattttcattgcttacatgataacataataaaaatttggattctaagtaataaatgctttgatattttatttatatgtttaaaatataatattataaaaaggataaatatatcggtgtaattttaaaagagtaaaatattttttaaaaaaaaaaacagatagatattttaatgatttaagccaaatcaaaagattttattattaagtatttgatttgccacaacttttttaaaaattactatatttttttttgaataatcaatttatatatatatatatatataatataaagcgtaagatcattttctattaacaatttgaatttcgtgtaacatttttagagttaaatcatcctcattttgatcccagcaatcttataaaaatcttagtaatttaatgataataatatatataatataacgcattaagtgtggaatattagcagcaagactataaaagaagacaacaccttggcaaccaagtgcctttcgattaaaactccctaccacagaatgaattctttagcactgtgttccctgttgctctccctttgcttgtttctcattgctcagtctccttccctaacaaatgctagagtgattggtgatggttccgacctaattgcccaaatttgcaatgaaaacccacagaacaaggattgaatgcacgaatattctaagagcagatcctaaagtcctgggtgcaaaaaattttcttgaacttgcagaggcaatcttggagttgggattgaagaagggaatagagggtgaaaactttcttaagggattggaacatgttcccgccattgtaagatgtgaaaattactatgaaagtacggttgaatcgtttaggaattctttgattaagttgaaagacgatcctctaattgctaactatttggccaaaattgctggtgatggacctttgtcatgtgaggaatccttgggtgctgcacatattgttaaccgtgcaatttctactcttgaccaccaaacaaatttgcttagctatattgcatttctagccacagagagacttagttaggcagcaccttcaatctaaggtctcttagtggtttagcatgttctttgttggagagtaattaataaaaatcaaattcaagttttctgctatttgtttgtggggtacgtacgtgtctagctaccaccattatcttttcttgtctatgtacaacattttgtttattgagatatataggtttagtagtgttttttataatttccaattttatctggttaataaaaaataaacataaaaaatgaaataaaagaagttaaaaagaggaatatgtcattgaatttaaacctattaatggtgattagtcgagttttccaagatggtcatcaataatatacaccataccaatgattaaaaaaatgattagtcacgtgtttttttgtcttatttgcctttgatcaattttttgtaacgctgcactaccgaagaacaccatgagcaaacaccatctcacaacttccatgcatgttgactcattctttttctctatttaattggttcttttgatacccaatgctttatcacttgtctatttatctgttgttttgctatatagctttgtttgtggtggattgattataaccctttttccctgttggaatgatgcaattgatataaatttattatcaattaaatatatgttatgcaattagcataaaaaataggctataagttgacagtttaaaatacttttatgaactttatgagctatattgatcttatttactgttggtcccagatgaactcaagagggggggtgaattgagttttataaaataattcacaatttaaaatcaaattcaaaacaataatatggagataaaagataaagagaacacaatcaattttaacgtggaaaacccaattgggtaaaaaccacgatgtccaaattggataaccaatccaatagacaactccactatgataattttgtgtacaagagttcctagtatcctagtttcctagtctacccttacacaacaattatcccagctggtatccttgtttcccagcaaaaagctctcgtctcaattcaccaagaatagagacagactggtatccttgtttcccagccagactggtatcctagtttcccagccaaaagtcgcacgtctcaattcaccaagaacagagacagaactggtatcctagtttcccagttgcgacctcttccaaacttaagaagaagaatacaataaaatagttacctttacgcttctattccttaagcaaataggtacctttaaatcctgatggagagttgaagaatcagtcttgccaaacacttctatatgatctcacaacaactctctcaatgatgcaaacataaactctctacagctctaatattatttggaatggaatgcatgctgtaaacacaagagtatgcttctatttatactaatttaaagatatgattttatccaatgaaatcctaaaagatattctattttaaaaatattttatcttatcatgcaatgcaatcttaaaaatattctatcctatttttgaatgcaatcttaaagataaatatattggcaagatcaatcttctaatctccttacataatatctaaaaaataaatagaaacaaatcttctttatgtcatcttgaatgatatcaatcttcagaattcttcaaataatcttatcttcaaataatcttatcaattatgctgatcttcataaattcaaaatatcaataacttcaaaatatcaaatccaaaatatcagtaacttcaaaatatcaaataattattatcactgcaattaatctaataatgtggcattcattatttgttatcatcaaaactttataaatctttttatgcataaagggttcaacaaatatccaacaatttccccctttttgatgatgacaaataattaatgtcatgtacaaattaaatgaacagatatactatgaatgcactatgaatgaatgatattcaactttatctactaatgattttcaactattccctagccttgctaagttatgactagaatcaataactcacaacatgacatttaaacctctttcccccttttggcatcatcgaaaagattaaaacaaacaatcatgatagagagaatggttaagaaccttagcaggaacagggatacatggaaagagcaacatgaatagagctatcaatgaagaacaagaaagtgataaagatgaaaggctgcaaagaaattaacattctaaagcacatgccttaacattgcaacaaattgctttttcgctcatatttaggatcactctatgttcttattctccaggctttctataagcttgtacatcatgactgctctccactcttagtgtagaaatatttcataagccaccaaatcaataggtctttataagcttgtaatgtataaggtggataagaaacaaacaaagaataaggtgagataggaaacaaataagtatagtattgatatgcatagtttcctactttcctctcaacttaatactttcaacatttttaaaataaaaaaaatcaagatgactacttcaacttttttttttatagtcaagatgaattttattttctttttctttcaactgtcattcctcctttttctttttctttttcaaccagacacctcatgaaacttgctttagaagatggattttattttctttttctttccactatcattccccctttttctttttctttttcaaccagacacctcatgacacttgcttgagaagatgatgattttttttttttcactgtcattccccctttttcttcttccttttttttttttttttttttttttaaaccagacacctcatgacacttgctttagaaactatgcatacctacacttaaaaggattttttttttttttttttaaacacaaagggttgcatattgtaaattatcaataaaaatcagagttaaggctcaaatggggtgactagggatataaaatactgaaagagttagcttgaaaggctcaaacgaccaaagatggcctatatcatttttagtaaacttatgaaatatctcaaacaatgagccttgagcttcaatcatacaagttctagattgcctgcctcacagagaaaacacacatgcacattattcctcacaacatagcaaattcactacaatatcaagacatgcacttcagagttaataacataagaaggtatatgaagtgaacgatgtagcaaagataggtgaatatggaggtgagaaaacaaacaagatagttcaacaaatatcatgaatgcccgttcttttctaaactagtcaatcattggggaaaagaaattttaacatattagttgtgatttatcagtcctagctccagtcttaatttttcaaatctctaacggcttaggggtttagtgaaaatatcagcaacctgatgtttagtatcacataacctaagttcagtttcttgatgatattcaagttagcatgtcctaacctcttatgccacaataatgggtcattatctaaaacactcaaacaggtgagagaaacatttgacaaacaattcaaatcaacctgataagtttttctaattcttttaccctctagaattacctcatttgaatccattctagttactaagcatttatcagaagtaaactcaacttggctacctttatcacaaaattgagaaatgcttaataaatcatgattaagacctttaacataaaacacattatctatggagtgtgatgatgacttaccaaccttacctacgcccataatcttccctttgttattgtcaccaaaggtcacacttccaccttcaaaaggtttgagtgagagaaattttgatttgtctcctgtcatgtgcttggaacaaccgctgtcgaggtaccacaagttgttccccctcactccaacctacagtctcaaatcaatgattagttttgggaacccagtctagcttgggtcccttcttcttctcaacaaagttagaaagcccatcttttctaacccaaacttgttttactttgcatgcagaaatagagttattcttaacatatgtgacattcttttcaatagcttttatcctattcttgcatttgaatttaagatgtcctaccttgccacaatgataacacactcttttctcatacaagttcacatgcttagtttttgttttccaagtagatttcttattacctttaaagcctaacccatgcctagatgtgttacaattcttattcaaccagtcaatagcattgggtctatctaccttgggagtcctaaggacagactctagcttattttggaggtccttattctctttagtcaacttttctatctcactctccaacttttcaattttttcttccaatagagcatcacaaattttcacacattcctctttcttatgctctttcaatttaacaaccaaagaattattttcgttttcaagttcagaagcaatattcttaaggctagtgatttcctcctctagactcttatttgtttttctcaattctttattagccttagagaatttcttaagctcattctttaattcaccaaagtcatcaatcaactcatcattatgttcacgtatttttaaatactcatctattacaaagtctaacattttcaatagatgcttctttgttaacaaatgcatggaagatctcagctcaagaaaatttacctcagtgtcttcaccttctgagtcagttccagccataagacaaatgttgtccttggcttcactgttttcagagccttcttcctctgaatcagaatcactccaagcagctatcattgctttcttgaactctttcttatcatacttcttttgctctttggccttcttctcctttctactttcttgctctacttcaggacaatccttaatcatatgacctgttttgccacacttttggttctttaagtgttttttgaactttcgcacaagcacttcaatctcctcctcatcatctgagtcatcactcacttcctttgattgagcttttaaagcaatgcctttatccttcaatcttacatcttcgtttctgtggcactctagttgcatctcatatgtcattagagatcctaccaactgctcaaggttgaaagtcttaaagtctttggtttcttgcaaagcagtgacctttggcatccagtcctctctagggagactccttagaattttccttacttgctcctcaacctgtatgtccctgcctaaagcatttaactcatttactatgttagtaaaacgagttatcatatccctaatagactctttaggcttcatagagaacaattcatattgatgcataagaagatcaattttagactgttttacctcgtttgtaccctcatgtgttacctctagaagattccacatttgcttggcagttttgcaacccatcacacggttgtattcttgtgtccctagtccacaatgaagaattctcttggcttgagcattgtattccaacttcttccaatcttcatcagtatattcgtcctcaagttttgacactctttctctcttttcattcatctttgtgatatgaaagtctcctttttcaattaccttccagacttgatagttctctgcttgaatgaaaatctccattctattcttccagtaattgtagtattttccctcgaatagtggaggcctttgggtagagtatccttctcttattgtttctattgggttcatcttaagatctactcttcaggagttacctgcaaaataaagagaacactgctctgataccaattgttggtcccagatgaactcaagaggggggtgaattgagttttataaaataattcacaatttaaaatcaaattcaaaacaataatatggagataaaagataaagagaacacaatcaattttaacgtggaaaacccaattgggtaaaaaccacgatgtccaaattggataaccaatccaatagacaactccactatgataattttgtgtacaagagttcctagtatcctagtttcctagtctacccttacacaacaattatcccagctggtatccttgtttcccagcaaaaagctctcgtctcaattcaccaagaatagagacagactggtatccttgtttcccagccagactggtatcctagtttcccagccaaaagtcgcacgtctcaattcaccaagaacagagacagaactggtatcctagtttcctagttgcgacctcttccaaacttaagaagaagaatacaataaaatagttacctttacgcttctattccttaagcaaataggtacctttaaatcctgatggagagttgaagaatcagtcttgccaaacacttctatatgatctcacaacaactctctcaatgatgcaaacataaactctctacagctctaatattatttggaatggaatgcatgctgtaaacacaagagtatgcttctatttatactaatttaaagatatgattttatccaatgaaatcctaaaagatattctattttaaaaatattttatcttatcatgcaatgcaatcttaaaaatattctatcctatttttgaatgcaatcttaaagataaatatattggcaagatcaatcttctaatctccttacataatatctaaaaaataaatagaaacaaatcttctttatgtcatcttgaatgatatcaatcttcagaattcttcaaataatcttatcttcaaataatcttatcaattatgctgatcttcataaattcaaaatatcaataacttcaaaatatcaaatccaaaatatcagtaacttcaaaatatcaaataattattatcactgcaattaatctaataatgtggcattcattatttgttatcatcaaaactttataaatctttttatgcataaagggttcaacaaatatccaacatttacctcaattactatcatacagtggtcaaaccctactcaaccacggccaataagtcacttgcttttcagaagcagtgctttgcatcagtccccaaatcagctaccaccaaattggcttgtatatgatcatatagtattccctaaatattatacttagcaaatcagctcatataacaaaatgcattataaaccgagtgaaataaataccaaatattaactctaattgtctacacacttgataccttttgaatcgtatgaactcaattggcattcttcactaaaattcccaaaccaactcagagatgaaccacagataatggtaagcaatctcgaaggcgtcgggttcccattaggaatattaaatactcttaaactctagcatcagccaatctcaaacagagcctaaactcttcgtctgaagtgttatgggtaaatctttagctacaactccaaccactttttttattatgaattgtcctacttttactttctgttgcatcgtaaagaattaaaaatgttcaatctatggaaggtatctaacaactaaagacatatcatttaaacaaataaataaatttaacataagaatagagtaggacaacagaatagctgaacattaacttttatttatatcttagttgagcatacagagcttattgatgagagatcacccaactaagcttagccttacagaaaatctctaagttaggaaacatatatttctaggaaatggttggtaaattgtcgatccaactatccttattaacgtaagaagctaaagaaaattctttgagttgtaacttatttaatttcttcatccacttaacacgctttgaagtatcagcccctggtcctttgcaatcaacttcagcataagtgaagttactcctacaagaatttgtttaaaaaataagacaaaatgacaaatatggttcaaaaaaattatgaatattacttttaatgtatcctttaagagataatatatttatttaaacttactcatggccagtataattccaagcgttccatccttgaggagttaccagagaggaaaaatatgttccatgaaatatgactctggagtaaggacgccaagctcttcctaaattcaccttcccatccccaaaaagggaacctccttcaaatacaaaaccacttggatcatcttgtgactttcgtccttgagctgtaacaaaacctggtccagtcctatttattccaacagcattgatcgagcaattctataagtggaaaaaaaaaattaaaaatattttattatttcatgtttaaaatgatttattttgaaaaagtatatttatgtaattacctcgtaaaatgattgtccataaccaaagataaaatccacttctccttcaatgtaacaatctttgaaataatgacgtccccttgcgtcaaataaggtgtcttgataaccaatgaaattacatctaaagaagaaggatttgtctccatatattcttgctgccaatgcttgtctaatattaattttacggtttcttctcctattcatgttgttatatgtgttctgcagttaaataaaaatacattagaaagaagaagaagaaaataatagtgaaaagttattaaaatggtttttctatcatttgttatgtaccatgaaaccaatgttagtcacaaccacattagttggccatgaagtgaatgtagcgctagtgtccattactttgtagtcccagaaagttatgattgttgtctggctgccctctccttctaaaatgatgcagggcttttcttggggaatataaatctttcctctgcacaattagaatatgggaataacaatatacatttggaaaggcgagtatatttctaaaatgcgatccaaattcaagaaaaaagtacacatgaaaaaaatccaaacaatatgggtattgtcttcatattagtagaaagaaagaaaaatacccagccaaatttgaaaagaaacatgataggcttagaacatgaaaggagccataaaatcaaccaatgactagttaagaaagttctttttctaggcaattagtttgttgaacatgcatacattcagaattatatgtctggtgtgtgtatgtggatttcttgaagctcttttagtaggaggagtcatttgtagcaaactaagatgaattaagagtaatcttaattgttataaatgattatgaaataaaccaagtattgctgttgaaaaatggaagaaggtagtatgatgttactacataaacgaagttgtattttcctgaagtttcagccatgaagaagctgaaatggactctagtgaatgaaaactgctgataaattgattttgatcaatgcctttttagcagaaaagaaaaggaattggtcctgttttggtccaagatcagaaattctaaaaaaaaaatggtcagccaaaaaaaggtgttttatttaaagggtaccaaaggcaagtacatgttgtataattagtagaactaaagcccccctgcagtggtatttgccctgcattccaaacaatacccacaatttcacgtaactatttctcttctcctttgcccctacccgagactatgttgttgctgcaccattgtgtataaatacatgtattccacaaggatgcatcacacaaaccatcagataccagataattagtagttcatatttgtaaacgttgcaaataagtaaattgtgaactaacttgatgccccctttttgactttccgcaagacattaaattgtttcattgtttttagttgttaagtaaatttccgatagatatgttgtctgcctattgtatgagtactattcttgtatgatttaaatcttgaatgcttccttattaagtaaatataacttatagttaagtgggcttgctttaattgcatttgttcatgtattcatctgtgttgtatgatttatatatacaagctttaacatctaaaggaatttgtaccaccatttcatggagcttgagattatgtagcatgtagtagcattatacataatgatattggcttactgatgttatgtgatattgattatgaaatggattaggaaatacagtttggttcatttttttattaaaaaaaaacagaaccatgcacacgtctagactaaacattaaacaatactttggaaagaacaaaccaatacttaataataacatttcaattcaacttacgtgtataagccagcttgcatatgaatcttgacccaccgatcattgttgtttcttatcgaaccaattgcagcttgaattgatccgaatgttacgttgccatgcccaccaacagttatggtgtatgaaatgtccttcccgccacaatctattttaccaagaaaaaaaaaaaaaaagttaataaaccaacaagaaaaacaatatactttggaaaattgaattgcttttgtaataaatagtaataaattacaaggaagttggttgcttctgtaatttatgtgaaacaaatttaatcttatgtttgtttgaacgaagaacgagaaaaaattacaaaatttgaattgaaaaggggaaaaaattaatagagaaatcttgaaattttgtttcttttattaaaacatattattattttttccttttttccccctctttatgtgaacttaacatagtataaaccataggtaatagacatcacattacatctaaatgaaaagttttgaaccaaatttaacaaactgattttttttttactttctcatttctaaaacaattttgaaaataaaattacgaaacagattttatatttttacagttgatttacaaaatagtttttaagaactaaaaagaaaaacaaaataataacttttatagtaaaaaaaatgaatatcagtgtgttgcttcttttgttcggatcagaaagtgtgctaagctttgaacgaagaaagaatggatggattatcgtaattaagaaagtaactttattaattattacttgaaagtataaatcttattaattaagctatattagtaaaaaaaatgtcagccaagggaaattcattaaagaggtaccgaaaggaatcagaccaagcaattggtttgtgcacttcatagtccccttctcgcatatatgagatatcagatatacatataaactccccatcaaagctaaccaactatgaacaatgacatacagttcataataaaagacttctacaaaaacgttcctaccaacatgaattctctactgagtccctgccaaggtttgtgttgctagctatatccaaatatatatatatatatatatatagcattccaaatccgagatgtgtttccacgtacaagtctttttaccaacccatcaaacaaattagtgctgattaatccaatcatacgtcacgcccaggacttcaattgtaccatatatatcccaaaccaagtaaatacatgaaagaagaacatgcatggatcatacctccacttcgagctgatatcatatgcatgccaccaaacaatggcattattgccaacaccaagcacccagggatgatgatattcatgactccaaataaaactttaaactttggttcaaaatgaaacttgagaggttaattcgttcaaaagaattgcaaagatataaggggatgatgagaggggaaaagagttctcataaaaaatgtacgttagtttatggcatatgtcaacaccagtgattcttaaaatgttattgattaacatttttagaaaaagctgagcataccttatagtagtaattcttttattaacgttacggtccatacacggtatataattcctataactttgggtaatgatgtcccacttttgacaacgatacggtagatacctatgtctatgtatattcttaacaacgccggtgtatattctacttgtgagaaaaaatcctgcatgaacaattttgctagaagtgcatacatttccaaagttggctccatgccccttgttttgagtttgttaccttccggtttctgctctcgtgagtcatatacattctactaatggcaatggaaaacacggaaatttttcatccagcttccttcaattaattaacatattgcttcattaattagagatgtaaaatttgatgctggccggttaggatccgtgactaagtttctcttctttttttcctgttttgtcctctattctccttggtggtttatggtacaccacaaataatgatcattagattgatctcatgtccacaaaactatgatgcaccctctgcatcaatgcaccaacgttcttcctctcctcagtgtcatatagtttgagactcaaaactgcagaggatctgaatttttggtgtcaaccaagtttccagaatgttagcttgttcaaaaaaaaaaaaaaaaaaaaaaaacttgttcattatttataattccaagtttcgaacgataaacccttttccatcttttgaattacttcaatctcaacgtgtttggtggcgtaaatggaaattcagagaccgtaagaaacacctcctagtttggacgatgcagtggcgaaaacgtcttggtcgttttgggcttgtcggaggaggtgcattataacttctcatacaactaggaagtttaacggtccatattataaacaaaatatatgatcaccataagtcacttattctactactctaccttagcatcagtattgtacaaattgtctaggccatgtaaaaaaagaagtaagagaatatgatttacttcttgtttgactttctcatgtaatcttataaattaattttttatcttttaaattttgttcaatttgattcttcccttaatttataactattttgttaataattctaagataatgaataaggatggcaatgaaatccgttctagtggattctcgttccgactttgacaattaatacctaagttgatcggatacgggttcgaggattatccgactttttaatcaaggttggggttagagatgagaatgtcactatcagcatggtagtcatatttatacccgtcaatcagtttatttttttgtagacaaatgtcctataatgaatttattgataaataagtagttaaaataaatatgtaacaatgaatttattttttctaaaataagatttttaatatattttttacaaaaaatattttacaaatctgaaccatagatggggcaggaacatggatacttgacacccaacgggtacaaaaatgagaaatcaaattttaacatgtcaaatatcgataacaagtacgaagataagttggaaagtcgagaactcaggagacaataaccttccccgcccgatccaattgtcatgtctaataatgaaatatgtcacaaaataaaatttattggcttggacgtgtttcttcaagtgtaattaatatagtgataaattttaatatatatatatatatagcaattattttgagaatgacgtgtttaaaaaaatcttcttttattataaagtaaatagattatgatgttatgtgtgaaaatattaaaaaattgataaataaatacaaatataccttaaaaaaaatcaaaattgtgtgtgcgcgcatatatatatatatatatatatataatttatagtattaataataatatctcttattaatcttcttttgacgtatttatatttgcattcaatatattaatatttattaaattattaataaatttctaatataatactgataataatagtattaatatatatctgtaatattattaatattaatatatatatatatatatgtcaatatttgtaatttttattttcataatacgaagtggtttcatttgatatatcctctttctctttatatataatggactatgatttttctatttatttttctctacatctataaatatatatacaagtttttaagaatatatatatatatatatatattagtctttataatgggtgtattatcttccttttatttatttatcaaaaaacttatgaaatggagaaaaagaaaataagagaattctaactcatataaaatgacatatcaagtgagataacttttattataacgtatcaagatatataaaaatagatcacaattacacataactattttaaaagttcacaagacttattgatctatatttcatttacaatagcttataaacaaattatttagattcatattataaatttttgtgagagtatttaaaaaaaaaacttataaaaatatatatctttcaactgctctaagatacttttaacttttttttcataaactcttaaaataacttacaagagtagcatatgtgtagcttattggaaggcacactggtgaatcatgttaggcacatttatagaggcataaatgtattttttatacatatttatcattttatacatatttatttttcgcgttaagcatctttaaatgatgaaattttttttgtttttatttagcctttcatatactttttatttatacatgtgaattgtatatttttaagcttattgatcattaaatatatatcatgttagacacatttttatttagcctttcatatactatatatatgattttaattttaacatcttaatttatattttaatttaattatgttatgattattaaatatctgaattgttttaaaactactgaaagctatatgattttttaacacagagtaaagaataaaagcaaactaataacattcgcagagtaatcttgatgtgatttttctcttggttaaggatatcctctgaagaagacatagttatatacttgcttccttattttatattattttatttagttttatttcaaccttaattatttatattaaaaaaatttaaagaggtattatagatttgttaattactatagattttgagtataggtaattaagatgataacatattagtgttattgcagggatagctatcattcaaagaattataacaaaatataatgatatcttgtaagaaattggtaaagttgtttaacaaacagaattttttttactttctcatttctaaaacaattttcaaaataaaattacaaaacagattttatttttttataattgatttacaaaatagtttttaaaaactaaaaagaaaaacgaaacaatatcttttataataaaaaaatgaataccagtgtgttgcttcttttgtttgtgcacttcatagtccccttcccacatgagatgtcagatatacatataaactccccattaaagctaacaaactatgaataattacatacagttcataataaaagacgttcctaccaacacgaattctctactgagtccctgccaaggtttgtttgtgtttctatatccaaatatatatatgtgtgtgtgtgtcaaacactagtgtataattcttaaaatgttattgattaacattttaagaaaaagctgaacataccttatagtagtaattcttttattaacgttacggtccattataattcctaaaactttgggcaatgatgtcccacttttgccccagtaatttaatgattagaaagtatttccttatttaaaggattagaaattatgcattcaaaaaaaaaaattaagaatatttccttgaatatttataaatatagttaaatgtaacaaaatatttcttatttaaggatattgttgatgagtaaagtaagaatattttcctgaatattatatttttaagtaaaaagataagccaaatatactctctttttttaatagtcaaacatctatctaaatctcattttaattgcttacatgataacacaataaatatttggattctaagtaataaatgcattagatatatataatatagataaaacgtaagatcattttctattaacaatttgaatttggtgtaacatttttagagttaaatcatcgtcattttgaatttttgatcccatcaatctgataaaaatcttaataatttattgattataatatatatgataaaacgcattaattgtggaatgttagcagcaagactataaaagaagacaacaccttggaaacttaatttactccacaccgacagcaaccaagtgccctttgattaaaacaactccctaccacaaaatgaattctttagtactgtgttccctattgctcaccctttgtttcttcctcattgctcagtctccttcgctaacaaatgctagagatcttcataatggttacgtcctaattgcccaaaccccaaatttgcaatgaaaaccaaccgaacaagattgcatgcacgaatcttctaagagcagatcctaaagtcctgggtgcaacaaattttcttgaacttgcagaggcaatcttggagttgggctggaagaagggaatagagggtgaacagtttcttatggtattggggacgacaaaagatgttcccgccgccattgcaaggtgtgcaatttactatggaagtacggttgattcgtttaggaattctttgagtaagttgaaagacgatcctcgaattgctgactatttggccaaaattgctggtgatggacctaaatcatgtgaggaagacttgcgttctgcacatattgttaaccgtgcaatttcggctcttgaccgccaaacaaatttgcttagctatattgcatctctagccacagatagacttattaaggcatagttgcaccttcaatctaaaatgtcttactggtttaattagcatcttctttgttggagagagtaattaataaaaatcaaaatcaagttttctgctatttgtttttggggtacgtaagtgtttaccattatcttttcttgagaaagttttaagtagacatgatgagtgtctagttcgagttttatgattgagagaagagaaatttattaaaggtgataagttaatttttttgacaaagatgatcatcaataaaataatttatatcaatatcatgattacaaaaataaatcatgaagtttaatggtaatgaaatgataatacaaaatactctaaccaatatcaaagaaaaatattacttccaactgcttaaaaaaattgttgaagctctcacctcaattagatagtagtttaatggtaatgaaatgataatacaaaatagttttttttttatgtatttcaaggtaatcttataaaagttaacaaacttatcatttagatttaatttgactttttatcttttaaattttgttcgatttgattcttccctcaacttagaactatgttgttaataattctaagataatgaatagacatggcaatgaaacccatagccgaaggtaccagccttgactttgacaaggaatacttgagttgatcaggtaccggttcaggtttaaagattattcgacttttttaatcgaggtcgggtcaaggatggagatgttactatccgcctcatactgatacccatacttgctaatcagtttatttttgtagacaaatgttctttaatgaatttattgatatataagtagttaaaaataaatatgtaacaatcaatttattttttctaaaatcagatttttaatataattttttacaaaaaaaaaaaaatcacaaatctgaaccggacacaaaaatacccgatatctaacatatacgagaatgagataacaaatttcaacccatcgaatataggagacgcatacgagatatgttgggatagtcggagtcggaaattgagtagccaatattcatcatccctaccttgtccgttgccatgtttgataatgaaatgtcacaaaaaaaattggcttggacgtgtttatgcaagtgtaattaatataataataaattttaatatataaatattatatatatatatataccaattattcacataatggcgtgtttaaaaatcatcttctttgattataaagtaaatagattatgaattgtttactgaatattataaattctttgaaatttaagccagtatataagactatcacatgaaaattctggattttgggattcatttctactgatccgttagatgtcaaacatgtgaattggaataacagtcatacgctaaacatttcaattagggcaggataaaatttggtcgtcaagcgtcacataatttgtatggggagatgagatccgtttaaatcgatgtaagaattgatagtttcacatcatttaataaatttttattggataagtattttacaaaatacaccgttagattgaaagcttatattatgtagatcacatgtctcaaatttcatattaatccgaaatcatttgatacctaattgatatatataaaattaacataatatatacttctaaaatatgtgaaaattagactatttgattacatttctattgatgtttaaattttgtgaaatttgaaaatgtgatttatatgatataaactttcaatctaactatgaattttgtaaaatacttattcaataaaaagttattaaatagtgtaaaactatcaattcttacacaggtataaactgatcacatctcttgtatggttgttgttggttgttattctaaaggctaaaatatgtttgatacgttttccattcctataaaattattaaaatttatttaactttgtacaaaaaaaattattttttatcctcgcaaattaaaaatatgatattttgaatcgaaactaaatttaattatgttcaaatttacgtgttgatgactaaacacataaaacctagtaaccaataagacgttgacatatgtttaaatccaatatgtgattcaaccccaaatctccccttccctccctcgtgctcttctccccatgactccgacaatgacacataaaacctagtcatgctcactttgcaatccaaccaactctgaaatttcaaatttttttggagacactcacttacgttctcgccttcgagacgctatattctctcatctctgcgattcaagttccggtttgggggatagggatctgggagttagaggtggtggttgttttagttcgaggtgtggcggtgacggtggtttaaggtgcagaggttatagcttattcttacaaaaaaaaaaattataatttgtgacaatttttttaatagtcacaagtttttattttttctgcaatttctagtgggtttaaaaatccgctaaaattgtatattaaaatttaaattaaataaaataccacacggattagaattcgccaaaacctagctctagataaaaagtcacattttaattttgcaagaaccaaaaaagggacaaaaattttaaaggaacaaaaacaaactttgataattttaggtgaacgaaaaatatattttactctaatataaaataatagactcacggaaaaaaattcatgctaacctgaccaaataaaaaattctatattagtattaaaataaaatttaaacaaataatgaaaggttcaaaaatgtcagataatatattttacggttgtaccattcattttcttatgccctttttgacgacaaatatttgtaagtaataacttactttcaaagttccatttcacacattttgaaagtgccccactcagctatcttttccattattctcttcatcctcgattgcgtgggttacaccaacttccgctggccgaataacacgatcataaagcatatatcctgcctgcaaacacaatcataagatacccttttattcatgttttcaatctcctaaataatctgcccaacaaaagtaagaataagaccacattccttcaagaaaagtatcagatgattgggttaaaaaaacataaaagctttgtcataaacactgacaaagatcaaccagtacttgacgcactgcaaatctatagataattaaccaaactgtgttgcatatccaacacgattcaatatgatatgcaagagaaatgtttgcaaaacaccttttattattaggtgagttgcactcgagtcccactaaataaagtagggaccagagttattttaatgacaccaacatgaaacaaatcgaataaagcatgttaaaaaagtgttgctagctcctccaataagcaaataggaatattttaaaacaaaataaaatacattatggtaatatatattgaataaatatttgtatatctgtaactaaattaaatttattcagttgttattctttgtgatgattcttaggatggtaagatagcaagagtgagaagtgctttgctggaaggtgaagggtgagaagttgagagcatgacctggatttgaatctcagtagaaaagatatagtaacaacaaaaatacgaattcaatattgttggatatggctcatctttcgcagtcagatgacaacccttcttgttggcggggtcagcagaaagtcaactggggtcccgctcttttctgtttttcgaattgtgtgtgattgtcgatttccaacaaatattaccataaaagtaacagtgttgaatatgaatatgatatagatatgccaccaattttcaagtaaccatgcatcatagacaaaaagagcacatcaagagttttgagtgtcaaaacaaattttaaaattggaaaaattgaatcacagtccttccactgtatattaccttcagaacagctgcaacagttcctggaggcttagaaccatcggggatttggaagatggcattatgcctgtgtggatcaaagggctcgtttgtaggatcaaacttttctacaccaaacttttttagtacctgtaaaccgaagcaattagttttacaataggctgaagcctgaagcactttactgtccaaggaagcatattatttcaagcatacaataatatattgtatagtaaaatgaggagtggcaccacactctctaacacactcttattgataaaaatttattgaaaactacaaaatcatgaatgagattcattaaatatggagtggaacccaaacatttttgtgatttccgacaaattaaagccaatataagactgttagaaagagtgtacttctcatagtaaaatataactggaaaaaacttttgtagtatgattataagttgagtttgaaacatgaaggaactaaagtccttccccaaattccccagttcccaacacacccatcaattcatcaaaattcaaaaggtaaactaaatatccaatttacaatcaagccactgtaaatcaagtgctttcagtacaaaataattattctttttttaaaataacaattcataaaatagttatgagaaattggaataagaaaataatttccaacatgttcatgatttaaaaaaaaaaaaaaaacatcatttaacacagaaaaaaaaacaagccccacctaatctcacagcacctgaacaaccatgtcctcaaacttggcataaagcctctactcctagtccctccaaatcacttttaccgtaccctcacattcactcaattaaccatcaatcgactatcattactaaacaaaactatataaatgaggaatttagatagctgaaaagaaatggggattaaaacttaaatataaaaatgagtagaaagaaaatattgataatagattagctatgacttttgaaattaaacagataaaacaaaaagtataacattctacctctgataattgtttctcagtcatttcaacaccttgtagaagtgttttcaggagtttcaccgcttcagcagagtcaccagccgtatcaatttttgaaaatttttcctttgcaactgaggaagctcttcccaaattgtccgcaacatccagtaaactctttgcaaaattctacagcatatttaaaccactcagaacacagttgaaggggaaatcatttgggacaaaagggatcaaagttggacctgtaaagcaaatttttttgaattatctgcttcacgtctagtcctttccatgacattctccatctctgcataagtacgcagaactttatcctgcattttttcaatctccttgtgctttaaggtcacaagttcttccttttcaaccacaagtttaattaaatcatccctggataagtcactttcactctctgaatctgaatcagaaaatgcagtccgtttaaaacctctcctccttcttttgacagtttgagattgagaatctgaaatagaacctgattcctctgttttatctgcaggtttatcttgtttagcctgatcattattctttgcctcttcatttacttttgcagggtcatcatttgtagaatcttcattatgcacattatttcctttttccttgtcattattttcggttgaagctgatgaagaaaacccaaatcttggagctaataatgaatctattggtggcagcaacaaattgatttgaacaggaatcacctggaacattagaaagcatgagaattttaaaatacatcaccaaaattcattagataaaaataattgaatcctagagaataggctaatgatagtcaccaatcaccatataatcatatttcatagtatcatatactacatcagaagaacaaaaaaatttggggaacctattgttccttcgtacacacaaggaatttaaaacaccggtaatccttaggaaaaatattttaaaaaaatgacagcgaacaagaatgagaatggggatagaatttagaagacaggacaggacataacatagtaagataaaagctcaggcacaatgttctttatcaagagaaaaaagttatactcatatttcatcgaccacttttttcattaaatacttatttccacacaagagaaaacactttttataacatttttttctcttttaatgtaataaaacacaacacacctgataaaaccctggcaaaaatggacaatcaaagtgaacagcagaaaaatgacagaagacatttcatcctgatattgtttttctaaaccctaaaatgacataaataaaatttctgaacatttgaattcaaaaccaatagctaaaacagataaattagcatcaaaagaggtacaaaagcaacaattaggggtaacactctataatgcaacctattccaaactgcataaattacgaatttctgatacacaatctgtcatgatccctaattaaaaaaaaaaaaaaatcatcactgaaaattctaggcaccttagttcaaaagttaatatattattcaaaaatacagctgaattcaaaaatcaatgaacagaatccaatcgaatgaaatagcgaaacggctaaaacagtcaaattaaaaagcaacctccttaaaccctggcaaaaccctaaaaccaaaaaaagaggggaaatcaaaggattttgggaaagtgtggaagagcaccttgttgggtgaatggggaagaagggaatgtaagttaatattggagagggtggacaagtgttggggtgtttgcgaagcagagaggagagaggttcggaaaatggtggtggaaacacgggacaaaaccctatgaacgaacatcgttgaggacgaagaagaagaaaagttgtcgaataacagaacagaacagagtgtttatgcaaaaacagagaaaagagaacagcaaagtctgtgctcgcggtggagagagaaaaacataaattggtgaggttatttattcattataaacgacgtcgcctctaagcaatacatctccaaattttaactggagtctgggaggattgttaacagcacacttttctttaattaacacctattcatatctctcgctgcatagccattaaatttattattattgtttaagatttattgaaaatgaataaataaaaaataatctcaataacattctaaacaagatgggataaaaaaattgattaacaaattttcatgggaggacaatcaaatttaaaaaaaaacgattgaataattttttttataatgatcactattttaaaaagaaataatacatataacatacttaacgaaaattctctaaagagattgacaaaattaggaattaaattttatttataaaaatatagaattatttaagattatttgttttaggaggattatttattttttaagcaacggcacttgttatgaatatcatctatgttaaacaattactctgcttacccttttttctaccatgcatcgtaatcgtaatggcaggtaaatattttaataaaatcctaaatttacacaaccaaaccaaattatatcatgactaatagtaatagctacattttatccaacaacgatagaaagcaaaagttcaaaacaatagaatagagtgtttgtagtgaataagtgtatcaggaacatagcatagcatgggccatgggcatggctttcactagagccgaaaatgtttttcctaaaagaagaagatgactaacaagctgcagcactccattgttcttcaaattgaacatgttggcacctccgaaatcatggattccatgtcacgctccttggaaaatttaaaggtgctacaatcaccaacacgaaaagctttgttgcatttgggtccggatcctctcttatttacgtaacctggatagtcccatctaaaaaatggcactttctcaaccaagaataactctgcttcctctgccagtgtcactacttctcagttattaaaagggtgagcattcttcggtgtcatgtgaatttctccatcttggcttaccatctatcttccttgcactcttcaaaaaccccgacaccacgtgcttctgaagcctaagttaaatagaaatacgtttagaacgtgtgtatataaaacattttatgttttcaatatttggtgtagtagtattgttcttcctataaacttactcaatctggcacggatcatgttccctataaacaaaaccagcatgtggaaaattgaagacagtgcgatcaaaatatttccttcggagcagcgggtgtttgttcatggtatgaacatccacttcatgcacaatggtgtaaccaaggttctccaatttgtttaagtttgttgaagccctggactggagtactaccctattaatgtcactaattaaagattcatcgtttaactagaaaaaatggttagaatcaatccacaaacacataacaaacgcagtggtttctaaatgagataataatgtgtctcaccaactattaatgactcacccataattttatgttgttttctataaattgagtcaaatctcatgagataacctacagttttaaaaaattattagaaattatgttagagtttgtttggatataatgttataagtgcttgagagtttatttgttgaaaaaaaaatattttcaatagaaaaattttcaaaaacacttgtaacttgtatctaagtagacacttactacttgtttcttttatatatttcagttatgacaaaaaaaaattgccagtaatagactttcatacccgttttagttgaaatttattagaatatactaagttttactccatgtatgaaaagtttcatacaaagaatgtttgccagcatttttcgaaaataatgcttattagttgaaaaacactcggtaatagtatttagtaatggtttagatgaaattgtttaatccgaactctgatgattatgggtccactctattcctacattatttcctacattattcttgcagcagctcgggtgagttagaagggaataagaatacatgaaagttgacatcatccatggttttaacaaaacccaaaaagtctattttaaccaaattcgacttgtaggtagttgtgtcatttggccactcggtacatacataaaatgagtatatgcagcaacggattatttcaatatttcaattaggtgaccaaaatatcccaaggtcatcatttcaaattagtgaactgactaacggaggtactctcacatatcaggtttaattagaaaaattaggtactaatccaagattcaaacttaccaaagcaatacatttccttgacgactagaccaacctgttaatcattatatttagctacactaaacacaacgggcttgatgcaaacaagtaattgtgttttgtctttattttctgtcttgacacttgattgtagatgacaaaatattcataaatacaaaaacatatattgaattataaaacttcctactagaaaagaacggcgacgcatggtacataaagatctcatgacgcacatgcattgcataaagaccccgtaaaatttgtatgctacaaatgtcactaactaatctaattatagcactgactcaattgctcagaaatttaatcatagggattcctaaaattcttcaagagattgggaatgtcgtaagctaacatgtcatcaactgcttgtatcatttttggtttcaatttttcaaacttatcaatattgtaaccactcaatctctctctgaaaaactctacatttggaaaatcgccaggaggtaaatggaactccctttgtacctgtttcaaagttgtcagtcatgtgtatacattttaagtgttgtcagagacaagcagataagcaaaacggatgtacacagattcatacctttccaaattcagctgccaaattatcgatgagcttttgttgagctttagctttgcccatcatagcaggcatctcctttttaagatgactgataatgtaagcatgtatcttggctgctcgggcccgttttacaaactcattgatctataacagtcaatatatacaaatgataaattaattatgcaaaaaagtaactttaacaatttaaatataaactggacactgaaattgaagatacgagatagtcacctacaaaaaacacctgtagaatttataccataggaaaggagactattgtatcaaacttgtgtgtggagtgcggatgacactaaaagctgataacattagttttcttaatttttaatttcacaaaagaaaaaacaatctaatcgatacgctggctttcttgtagtttcactaaaaaacaatctaatgacactaaaaaactattgtatataagggtagttttttaaactcttttcaaaactaataactcttttttaggtccatctttaagttgtttcaattttttactttcagtttgtattactaatgttctttcttgcactttcacattttccccactctttctgaaaattagttcttgaaaaatgttttataaaatagtttttaaaaactaaaccaaaaacacaaccaaacacacccaaagtaacctcattttagtggaaaactattcttatgataaagaaaataaatttagttaaataactcactcactcttcgatcacaagctgcttttggtacatctttcagatccgagagaagatcatcctgttccttttcaaagagttccttcccaagtggaccagtggcagcatcatttacaggtttgtcattgaaggagcttccataaagaaggttaattatgagcaaatgagcacatggcaatctcataaacaaggaaataaatatacagttatattatgtctaattgcatagcaaatggggaaggcggtgtggaagagatcttccactgagagtggagaaacaaagcagtctctcccccaccctccataacaaagacaacacttgaacattgagtggagacatacccaatatacactcgcattacttcaggtgtcttcagcaccttcccaagtgaccacattaaggctccataaaccctcatcaactgcaacagagagcccaatataggttaagatttcaccggactaggttgtgaaagattcaaaagataaacaaacagaagtttgactacacaagctcttacttgttgagtatcaacttggtctgccttgttcaaaactactcggattttgtcatcatgcccccgtaaggatgatatcacacgattgaactcatcactgatgtccagtttgtgaggatcaaacagaaggagtatcaaatcacacttagcagcaaaccaagatgttacacccgtaaaatcatatgctcgttgtgtacgttgcttttctccagatagaactccaggagtgtcaacaaatgtgatgtgttccagtagctttggacaattgaaagagtcaattctaaatgctataaagggaaatctcgtaaactttttgaacagatctagatcaacttacaggatgaggcatttgtgaacacacaaattttgacaaaaatgctgtgccaaaagttgtaagaccactaaatggcatgtctgcttggacagcaacagtatttccgggaacgcttctctcatcagatccagactgtacatcagcatcctttgctagttaaagtataaaactaatgcaataactcattttcaagatgactactagattaaaggattattaagaaaataatttaaaccatcaactcttggcactaatgctatggtacgaactactgagttccattgccaagttttagaattttcatgttatgaagaatagacacacaaacacagggcgatgtcctaaacatgtgtgagcatgagcgtttgcatgtcaaatggaattaaaaaagattaacatcacaaaatatctaaattgagaatctgaatttatattcaccctctcaaaataacttgttaagctttacttatgccctactataatgagccccacacaaaaaaaaatattaagaagcatcattttacattttccctaaagaagtttctttagcattttgtatcttttaaatagtttatattattctttatattttaagttgatttctgaaagttaaaacattttttcaaatttataaaatagccttgtcttttgaagtctcaagcgatatttaggtgtcagttgacagagttgaatgaccaaaccatgttaacgcatgtccaagccatcaacaaaaaattaattaaacaccagtttagtagcgtccaacacatgtcatacaaatgttaaagaagtgctagtgttggaacttggaagtatgactgacactgcaagaaatagcagtgttgatgcttcatagcttccaccaagatgttagtcttgccagcaattagaagtcaaattgatttattagtttaaaactaagaaaacattgaaggtaatagagagtcgtgggagataaattgatttggcttacacataccatgacaacaacaaacctatcagttgttggttcaggcccaatatgtgctcctatcaacatttatgggaaaaacaagacaaagattaataacattattttaaaaaatatgttatatcaccctattaatcatcctaaaattttacaaagaatattaaataaaataaataaatgtatttaaaattatttcttcataaaacagaaataagcaatgtgagaaatacatatatggatatagtgaaaggagaatcacgtgcctggataactacttttaagcagatgtttgataaatgttgttttaccagttgagtactgacccaaaagcataaccattggtttggcatcaaagtcactgtttgtctacaatatgaaaagaattacaatcaataacaaaattaattgtatatctttgtagatatttaaaacatagtgacaacatgagtgcataaagaaaggtagagtagctagtcatttctaaacaaaataacttactgaccagtaatggggatacaaaatcattaaaacggtaagtaacttctaatggcttcaacttctgaatgtagagtctcttcaagccgtcaattattgatgtcacagaggaaagaggcacctatgaacatatgtaccacaaatacaagtaaaaacacaacaaaaataatatttgacaattttaaaaaactggcaataataaagaggtaacaaatacagataaaaggtcctagagaacatatctataggatgacctttagggtaacattaacttgattcatataacattagagacaaaattagatatttagattgacacgagacaaaatgcacattttgttaagtcaaaaagaagaaattagataataccaattctagattgacacaacaatattcacatgtgtagtatcaggcacattactattattggctaataatatcagttacacatgcattgaaattaaataataaggttggtttcaggcccgaaataattacttaaacacatttgtttcatcatcttataaaagacagagaacaacataaccagaagtttctcacatatactctgcaagatcaaaagaaaacactaaacgaaaccagaacaacctaaagccagtaaagaatgacaatcaagttggccattacccattagttgaaaacttgaaatgaattctagtggactggaaggtaaggataatgcacatgaaatcaatcaaagtaacagtaacagaatgcttgccttttttgttgactttgaagaaaaccaattacttgacggcgatggctgcaattgagagctacctgcattattgctaactactgaacttagatttttagaagaaaagaacaaataaaataaaataaaatcaatatgaatgaccatatttagtaaaacgagaaatatattaccatttgcatcaacctctttttgtttatgctttttcttctgggtaaatacgtcaaatggtcagaactttcactaaataagcataaaaatgttaacactgtaaaaaaaatggaccttaaaaagaaatacttacagctagtagtacgtccaaaccctccattgagggaggtttcacatttgtaaaatcaactgaaataaaagttaagcttccattaggttaaatttataagaagacattcacaatcaaatcaaaatatgtaagcaggcacaacaacaagaatgtgctacaattataagaagttattcaaacaaagtaatagaagacaaacctaaacatacattacttaccatcactagtcagcagatcgggtgttattgagtgcccagattgagccaaagaaactagctacacttcagatgtgtaagattttggaaatttatcagcattgaagttcaaaaaaagcataacatatttttacctgcatagcaatgataaattcagtgaaacctagatatccttgtcgctttgaatctgcaatagcccacaccttattttggtaacagaagcaaacaaagaagcactttagttagcaagaaagaaagaagccaacagagatacttataagcaaggacaacaaattatattaacaacacaagtacacaaccattaaatgcccaaaccatttcagttgttatagataatacaataccaaaggcaacttctacatgagatatattgtaagagttcaaaattagtccattatcagtataaaataaacaatatcaggaaaccataaagtgtcacatcataagtgtaataaaaaaatatttcatttgcaaaaatagttgacaatatttgacaatatgcttcaataacaggataaaattctctataccaacaatgcatcagatttgaatctgaattgcaaaaatcaaaaccaatgtagctactggataatataagaagcattccccaaatcaaaggacaacccgattcaagaccagcaactaagtttgactcggcaaagtgaaattgaagagggatttaagataggaaggatagaggaagttcacagttcactagtgcatgcttgatagcaaaggcagagaagggaacaaataaaaaatgaaagtaaacaacattttgttttatattgtttgaaatgaatgagataataaatgaacattaaaccaaaattggccaatttgtaaaaccatagaatcccagtgttatctctttctacaattgcatgtacacttcaatttcacctcactttatttatttatttatatattttggcagagacaacagacatccttcatgtaaggtagtcctgattgagctagatagaattactatcggcagaaaatttaacatgaatatttaatgcaattgaatagtcaggactcaaatttgagaacactaattaagttggaaacaaccatatgtcaattgattcaggcaatcagtggttcacctcactaacgaggaaaaccaataaaaaggaaaaggtaggccatgttaataatgcccaacttttatcacttttaacttcatcccctaaccaagcaatcatatcttagaattttggcacgtcattccgattacctccaactcctatctgcattcattcagtacaatacaaaagaacgacaataaagaaagaaaatgaaaaaaaaaaaaaaacgggaaaacagaaaacctgcttaagatcttcgcgggacaaattggacatggcgaaaaacttggtggcatcactccctgtaatgcggccatcgctatctgaaaaacgaagtgcacggtgaaatttttggatatgaacaggaacagaccatataaaattggaacaaaaaaaaaatactggaagatgaagtatgctgtgctgtacctgaatcagcgcaactgaaccactccttatagatcgtctggtgttctttggagcacgaaccgattgggatcgggtcgaactccattggtcgcagaaaatcttcggaatcgcgtgtttgagatctcgtagtgtttgagatgctgcgtttgaacgctttttaccttctcagggaacagaaaacgtgagcgttaaacgacaacgaggacttgcattagcggtgtcgtattggcgatggaaactaacgagacagagttggcgcagaaatgctgctttaacgattcctgtttttgtttaccaaaaaatagtgccaagttagtgaagttgggagtttcatctgaatgcgccaaattacgccttgtcgcgcacttcgcactcactcacctttgcttgctgattcagattgtcatgttaacttcacgttaatatggaaattcgtgtcaccactctattcttcgttttattttttttattttaatccatattgttaatattttttatattaatttgactattttgaggataattcttttaattggtacccatttctatcttctgacttttttttataaatcatcttttatctcataaaaaaacttctaaggtgacaccactctattcttcgttttttttatttaatactctacaaaaaattaaaattatttccttatattttgtatacacgcgcttaacatcatcataaacaaggtaagattatttttatgaaaaaaaaaatatagcgtaagattctattatataaataatagtaagaaattatattgaagttgtttggagaattggatgctaaacgaaccgaatctcccaaggaacctctttagtctttacccttttgtcaacctttgatttttacttaattgacctaggaaaatttcttaattgacctatcttgatttgctgacacatgtccttaacttgttagatatataaataataaaaagagaaaaagaataaaggttgcttgctttggtttggttgatttcattatcgaatattattattgaaaaagaagaaatttgttgatggattactacgggttttgtgactaactagttttggtttgcttgattgaagatcaaggaaggaagcaagatgttgggtgttataaggcacaaggtgctgtctgtgtctgtgtctgtctgtgtctgaagtctgattcctattccaattacatttcatatgatttattttatttgcagagtattcgccctgccttctccgcagtcagacacttctcttctgcatctaaagaggtatgcattattgttctcatctctaatctcttaatctcttactatcaaatatcaaactcgccagtgttgtttcgatgcagattactgtcagggaggctctcaactccgcactcgatgaggaaatgtcagctgatcctaaagtgttcttgatgggtgaagaggttggggaatatcagggtgcatacaaggttggttaattagtttagttgtcttgccaacctcaccttttaagaacttcattaacttaacttccttctttcattttagatatccaaggggctgctccaaaagtatggccctgagagggttcttgatactccaatcactgaggtcgtttttcttacttcatactttatttgcatctcttcacttgatttattaatggtgatggctttgggatgcattcctttgaactgtgttgttcttcatgcttagcagctgcttctaactttccataatagattgcttattgaacgccaaaatttactttttttcagcttctcactttaaaattgataggaaaataagaacaggatttatttatagttggttgcagctgttggattgacttttttttttttgtgaaatataatacaggctgggtttgctgggattggagttggcgctgcttactatggtctaaggcctgttgtggagtttatgacttttaacttctccatgcaggtttggagtttatcttgattgcatcctttctttcttaaattgagtgtgaacttaagtgatatatttttttacaacagcgccacttaatttatgtatatgtacaatgttatgtaaagtttactgtccaagaagatattagatggcattgtatgagtcttatcttctgtgtgataagataccagggttatgagattttcaacacatgatgattcattccacaaggaaaaatgttgacttccctgtgaggctgtgttgataatcacagttatgaatcaaggatatagatgtgtgtggccaaccctagaaatgctttagcatgatagcaactattttgaagattatgtatacaagataaatgagataattaatttacagttgatacataaatggtcaaaaataaaaattactcggtgaaaaacatttagtcattgataatcaaaagttatagtgatatagtctagacatacaatcatcacaaattacaaatgttaggcataattaacaagctaataacaacaaaggatcataaggatataaaaagtacagtgccaaaccttaataagtttgagcctctaaggtgttggaggaataatgccatgtggactatgaagtgctagctacacgacacaaaaggagaaaaagtaaaaaacaactaaacaaaacagagggggtctccaagggctcactgaggtgacaggatgggagttgctatgtagaacaccagcgggttgctggaaaatgacagcaaacaacggaaaatggcgaacctcaaactagagagtggaggggatgtgatggaaaacaatgcatggcagtaaatggcatgctgctgggtcctttggccagaagaaaatgatgaagctcaagctagaggggaggcatggtggatatgacaatgtaaatcagccgggcacatgacgaaattcccaatagtggtagtgatttgacacgttttgggcttgtgatgtctgctctatcaaaatccaatgtgattctctgtgcattgtggggacaacaaacaaaatggtgtgaatttctgtgattaccctgttattaaagatataaaactaaggatttgtggttgggattcagtttattgttaacagagacaaccattcttggcttaaaaaataaagcaattttgtggtgtttaactattagtttgaacatcacattgatgccagacaaatcaatctagtttggtagacgccaggcaggcctttttgctggaattttgttacttgtcaactcctattgcttctatgttcaagtattattcttaagtatgaattatgttggaagatgaaatctctttcttctggatgaagtaagcctttatgtttacaatcttaatattgagctttggtagcttgaatgttgaaatactaataaactgtgaagaatattgtgtgaacatgtgtaatggtgtttattttgggcttcatttgtttgatatacagctgcatcatcttgatttattagctagcagattaattgttcagttttaacctttgttgcaggcaatagatcatattattaactctgccgcaaaatcaaactacatgtctgctgggaaaatatccgtacctattgtctttagaggacccaatggtgctgctgctggggttggtgctcagcattctcaagtacggttctcctagctgttttcttttaaagacaaactttatttaaccatttgagaactgataaataattcaggtttcgtctttgtatgcccaacaactttgcctttatgcagtgttatgcatcttggtatggttcatgccctgggttgaaagtcttgtcaccatattcatctgaagatgctcgtggtttgcttaaagctgctataagggaccctgatcctgttgttttccttgaaaatgaattgttgtaagttgtgctgcttgattctcccgccccaaaaaagacacttgtgctgcttgatctgtacatgaaaatgagtagtcatagattttgacatcagttcttgtttcaaaaaatatttaacttgatgaattatgtcctctagatatggtgagtcattccctgtttcggccgaagttcttgattccagtttttgccttcccataggaaaagcaaaggtagttaattatctgtagtatattaaataccccttatgatttttggagccatatttactacacaataatacattcttattgacttcttgtttgcttcatgcattttaccactaaacagattgagagggaaggaaaagatgtgactattacagtctattcaaaaatggttggctatgctctcaaggtttgtttactgttagatccttttgtattatgaatatgtaacatgtattatgtgctgtttacttgtttgttcaatttgctgcaaagtatgtgaaagatataggtttgtcttgcatttaatttaaatattaaataataagataagacaagaatcgattataactttttttctggatgggttggtgtgttatgtggtgttttataatttgttttaaaaaaaattgaaatctctgacccctttaagtagagaacattcttaaatatatcttctattggtgtttaggctgctgagacactggcaaaggaaggaatcagtgctgaggtaaaactttagtttataatgaacttccccccttttctgcaaaaacatcatttgggttatgataatggtgcgtgatgttcttatccacataggtcattaatttgcgttcaatccggccgcttgatcgatccacaatcaatacttctgtcaggaaaaccaacaggctggtgacagttgaagaagggtttcctcagcatggcgttggcgctgaaatctggtttatctctttacattaatttgtttttgtatgaatgtatcttactggttaactcttggcaatcatacgagtgtgtacttctcttgcacagcacatctgtcattgaggagagttttggttatcttgatgcaccagttgagagaattgccggggctgatgttcccatgccttatgcagcaaatctggaaagaatggctgtcccacaggtaatggttcttaaatattaattattttctgtgactggaagatttgttttcactattttgatcctgtaatgtatttctattttgaatgggtgaaatgccctgacttgatggttttgtaagagatgagttttgtatcctgataaatagctagatgctaatttgttcaaggttttggtacatgtctatccttcatttaaatttgattgcttcctggtatatgtggatgtacaggttgaagatattgttcgtgctgcaaagagagcatgctacagatccgtgcctttggctgcatctgcttgaatgttctggaaatttttcatgtcctggtcagttctttgcagaaacaaaaaatttccctaatttcctctataaaactgcaggaagaaattgcaaccaaagaatgttggttttaactaatttattatgttattggtttaaaagattctgtcgtatgcataatactgtcctaattttcaggactcacagatgctatacatattttccccatctcagcttatgtgggaggaagttaatgttaaataacttggacaacaatgacacaaggcagcaggaagttttcaatgtttttggtttctgcttggcaataactaaaagtcaactttttgaatacgttatttccagcggaccactatagtgcaagatctaacttgctgttagtttatcttcgtttactgttttagttatattggcaaactagagatattttatttgatgtgaggtctgtattcttgaggttgtgggtatttggttttgtgttaataatgtgttgtgtcctctacttcttggtgtatgtaagactctgtaaacctctaaacttcttttatactaggcgttgtttcagttagaccccacgtaattattgtattggccgatgttaatgtcaattggatcgtagaaagcgcagaaaattagactagaaccttacatttttcccttttacacttaccagatttagtttttcaattatctgaatccattgccagagtttgagtctaattttgatccttgtttaaagttttttttcaccgtgaatcgtgtgttgacaaatcacttagagaggtcttttaaaatactagttgttatagtcttatagacaacttcatttgataatgtgtgggtgtattgtcaggggaagataatttagcaaaatttaaattaaaacctattttcatattttgatactccgaaacaaaatatatgccactaacattagcaattccaatttgttgtccatagtacatttgagtggtagggttttggaggacaaagatagtggaaattttttcatttctactaaatgttatatgatttgataaatctttaaaaataaaaggaaatgatatatgggtataattttaatgctattatttttttttattcttataaatattgtattaatttctgaactttgaaacaaaaaattatcttttttttttctccacccataacttttctattatctttttgtttgatgttttagaagaagaaaatgttccattttgatcatttaattaatgaagcattaagtatttttttcactgttatattcttaacatttttatttttaaacggtttattttctacagaaatagctaaaattgtgaaatctcaattgtcccaagcatgctcttaagttttgtttggaaaaagtagttgaaacttaaaaattaattgatagatgaaagttgatagttaaaagttggtaaactaatttattaatagtcaaaagtctaacttctccgtcataatacccctaccgtcttccatcctctctcagactattttttcctctccatttttaattgtaatcaaattaattatgatacaaattaatatcataaattgaattgattattgttaataaaggtaattcatataattaatctggttatgctggtaacttgtatccaattaattcaattttaattaaaataaagatactaattactattaaaaaagataaattatatcacaattaatttgcttgctttaaaaaaggtaattgcatttaaaatcaatttaaaattcataaaaatttcacaattaaaacatatttttgttgtataaaaagaggtataaaaaaagtacaaaaacatgatttattaacaaaatacataatggaaacatgtttctgttgcgtattttttacactcccttttacacaatgaaaacatgattcagttgtattattttttgagtgaaaaaatacacaatggaattatgatttcgttgtgttatttgggggtaaaaaaaatgcataatgaaatcatgattttgttgtgttatttagggatgaaaatttatacaacggaatcatgtgttcgttgtacaaatatacaatgaaatcatgttttcattgtgctttgatttttaaccccatataagcaataaaatcacgatttccttgtgtttctatcaaaagaaaattttcaggatattgctaaaaggcacccacataggtagtgctaataataaaaatgtagtgtcaatagtaactctcttaaacaaaagatcataaagaataacacttatttattgctataaagttgaaaagtatcgacatgaagtaacctcgaaagagaaagatgaacgagcaaagtttgattaatgatatttttttcggtttgttttttagaattgccaacaatacccacttttttatccttgttgcttaaaatttattggaatttattaaattctgaaaaaaaaaatagtagtgagagtcactccattacatgaattttaattagataacatgttggtagtattttttagaatttttttttttttaaattgaagcacttgaatctccagagctcaagaagtctctcctctttgcttgttattgctccctcacaacagaaacactatgttcaaataagaacaatatttgttcccagattattgaaataatttttattattgtttaaggaaattattgaatgagcctagcaaaatttaaaatatataccaaaatattataattcctaaggtcatttattcaatttatttgcattgaaaagattaatttacaaacctaggtaaataaaatgtaaagaagtgctttgagtaattattactatttcttatatatgacaagttggagttgttaattttctaagagttagataatatccttatgtactttttctctcatgtattcatgtcataaattctttttttttgtttcaatttatgacataagttttctctgtttttccatattaaattaaactatttacaccttttcaattaattattcattaaaagaaaaaaattaatgcggatttttttaattaacataagacacaacgttatatttacatatcatcactaaaatatttcctttacaattattattttatttcaaattaaaagtttaaaatatctgcatcttttatatttaattatttttattaaactaaaataatattgatcaattacactattatttcagatcaaattatatccatttaactttaataactattatattatttttataatttaatataaaatatgatttttattgatccaattattgaattatatctatatattattaaaattgtatgtgtcaaattttattaaaattgatcaacaaaaacatattcttaagtgctttgagtaattttataattatttaaatttaaattttatatatatatataaaataatatttaaattacactattatttttaattttataattatttttattaaactaaaaaataatatttatcaattacactattattttcataaatatatatgaggagatcaaattatatccatttaactttaataactattatatcatttttgtaatttaatataaaatataatttttattgatccaattgttgaattatatctatatattattaaaattgtatgtgtcaaattttatcaaaattaaacaaaaaaacatatcatttttaaaaataatataataattataaaattataccgatataattttatcctctcattcatatatatataaaaaaaaaaaaaaaatatatatatacacacacacacacatgtatatcactcgtatttaaggacaccttgtgatgtatgaaggagatacttactagttgctaaaaatttgtggtgcataatatttgaatatcaattgggtagtatctcagttccataatatattgttatttttcgtgtctccattgtctattgcatttttattctttttttataagcaactacgatgccttaaaaaataccgaatgagttaagggatataacttatttggttgagtattttataaatctcttatagtgtcttcgacgatattttgaatgttgattgttttcatagctgttttttttttttttttttgttctgaggtggactttgattcacattcagtgtttgttatgtggaagcatgtcacgggcttcaaaatcctttgtggggcaagttaatcggcccacttagtttttcttttttctttttctttaagtaaagagcatataatgcgaatggaggccatgatgtgctgcggaccctgccagcggcaactcccctaatttgaaggtaagacaatactagagcaaacgaggtacatacatagttgagaaaaatgccccccaaccaagacgtggtccaaaccctaaacacttcctattaacaaattttgatacctaccctacctttgagttgcctctaatcacaattcttggtctttcagaacatgattcccatcaccaaatctattctttatttccttcttttgatttgggaaaatattagtgcatctaagcctagtcatgttatttacttatttaaaaagaaaatcgtagtcatccgagataatttcatatacaaatattaattaatgagcaattgagcatacaatcacacaacattaaacaaacggataaaaaaaaacatagcattaaacaagagaaatttgacagatatagcacaagttacttttctttttatggcttgagcgttacagaatgattttcaacccaaatttaaggagaattttttgtatgatttgggatcatcataggtcaattttcacacaaccaagattctcaattaaaaataataataaaacttgattatatgttttttttgtgagtcataagcttgattatatgtctcacataacattgggatgagaatggtccaaaatgatgtaataaattctcaattttaatggctggaggtgaaacaagttaataattaaagggagaagaacaatttgttgggaacttattactaagatctcaccaattgatgtttctctacaagaagttgtgtggcgttaatcaatcccatagagagagatatgacgtatgagtatgattactagacaaggaaataataagtggtaaggtgaggggcacctaggtggccatgcaggaatggttggttaggctgcaacattacattaggcctccattgaattctcaagggtcactttacacggtgagtgcgtgtttaagctggcgttgacttttcacaaatctctaacattgcaccttattttatgctatgcttgatgcttcttcaaaacaaaaacaagacacaacctaccatccccgcggcttctagaagtgtcacgttcatttcattaagtggggtaggaatatgcaaagaaacccctattttctctcttgccaaacaccccttcctacaacacatcacaacacaaggtggcctaatgcttcatcattcaaacttctaacaccgtattccactatccttttgataccaaggaagaacgaaaatattatatatttttcaactaaaaaaaaaaaaaaacatcatagtacctatgttttcttagccctattattttactcgtaacgttagattgggctctaaaacttaaccatatgcagggctagacaaaaacagaaacagaaacattaacggtgacatttagattgcattgattcttttcttacacaacctaaattactacgttacaagataccacaaaagaagaagaaaaaaagaaacgatttttctccagtccaaatccaatcattcacacctagatctaaataacccacgctgccaaacagcttgagtgccatcggaggcaaaatgatagtagtagttcttttcctgttgcaattgctcccaaaataagaaaaggtaaaaacaaataatcactccactcaccaaacaaagtttctttgaaagcgctcttgcttacacttggtcataaaggtaaggaagaaaataaaaataatcaaaactacaataaaaagccttttggtaccggaaaagctgcatttgctttgcctcatcatgtaacaatttacatgaaatcaatcaaattcaatttggcgttacattcaaacattggaaattcagctaatgaaggcaaaaagaaccaaaccaaaaaataacgaattgattttccaagtgtagagaaaaatagtaaagagaaataactaaatctaagtgttagagcaacactgaatttcttaactatgataaattgatgcatagaaacaaagagaagaggatcggagattacatacatacccacattggattacccacaaattcatcttgcttttcaaacaaccagatcataattactttctctttttttcttcccattcaatatttcctttcaaataaaatgatttaaaaaataaatagtaaaaagaagaaaataatatacccaacacggaatctgcctctcacagaattaagatcatattaccataatcttacatctgatcatcattttttaatatattttttttccgcatagcaataacaaaaaaatcaagttgaagagataaaaaaaaaatgagaaattaaaaatcatcatcgcacgataatcatcagagacaaagcgcggtgcagcgtagatcatcacccgcggcggcagcatcatcatcaaacggcagcgcgttgagatcgaacggcaagggaggtcgaaacgacgaggaaacgatgttgtcgtcaccgtcgtcaacgacggaggaggaagagtcgcagtcactgtggcagtcttcggggacaagagggggagtgcgcgggtatctccgcgtagtggtcaaaaacggcgacgtagtggttgtggtgggagggcggggcccactgaaggactcaacggtgctactcatgccacttgaagttggtctctgagggttgttaaggttgtcgttgtcgttgttgttttggtggtggtggtggtggtggaaaccagcgtagaagaaaggatcggtggtggggtgttgatagcaaaaaggtgagagagggaaattggttttggccttggaacctcggagagtccgagcggcggcgtcgtaggcacgtgcagcatcctcggcagaatcgaaggttcccaaccaaaccctggctttcttcaacgggtctctgatctccgccgcgaatctcccccacggtctcttcctcacgccccggtatcgaggctcctttaaaacggatccgttcacctcagccaccaccaacgccgccgccgaggctcctcctcctctgcccttccgcatctcttcggagaaataatgaaaccaaaaaaaaaaaaaaaaaaaaagacagacaccgaggttcgtccgacacgacaaggtgtggtcttggattggattggagctcagagagacatgtgtgtatgtatgtgtgagtgtgatatatattaatgggtttttttcacaagtgggtgttatggagatggaagaggtataataagatgatggggatgagaaatggagagagaaaggattgaaggcggtaccaccttctcttcttcttcttctgctccttcaactacacacactcaaatatattcttaataaataatacaaaaaatgggtcttcagcgtgttcgcgtttttcttctctcaatggctttcctgcctctgtctgtctctaatctaatgccatttttttattataaaaaaataacttttttattttaatttctttatggaaaaatatttgtcaacatctcaaatgctagttaacacggaagagaacgaaaaaaataaaaaatataatatgatgagagaaaaataaaaaatattgataaattgttcaaaattaggaggtgttcaaaaatagactctttctttgttgcctttctggctgccttccttctctaactgacctcttgtcttgctttatttatcccttgctttatctgctgttatattattttataaaaagaatctctgttttttatgtatttttctcgtttacaaattacgaagagtgagttaagggattctcgaaatgacgagaaggcccttgggtttcttggaagtaaatttgccttgccttggttggtgtacttttgatttggtgaggtccctttcatgatagcatacctctgattatttcttcttcttttttcttttttttttttttttcttttttctgggtgcacacacagagggaggggtaaacataaatgcaacagatgaagatcttatctctgttttaaattttaataaataaatatactaatttcctttctatgaagcaatggatttcgatcgatttcctataaagaaattagtttatacagtattttcttttcatctatttcaattatttcggctgtggacgaggaagcgaattatgtgccatgcgtaattgcaattttttatagccgcttaaatgtttgtttttatttttgtttttcataagaactttattaattactaattagcagtgtgaactaactatattttatctgtacgtattttttaacactgtatatacacgatcttaatttttacgaattatgattctacattattattattattattattattattattattattattattattattattatatgataaaggggaaaaaagtccaagcaaaaacaaacagtgagtttaaatagatattaatagcctccatcttagtttcaaaaacatgaacttcaattttaagacttctcaattaagcgatacaaatcttttagtttaggatattttaaaaattataaaaatgcttacgttaatccataattgtcaatgcggttaagtagctcacttactctttttttgtacaagaagtatctcacttacttaaaaatacatattccacataattaatacttaatgtcgtagtttcattttttgctaaaaatcagaagaataaacaatgtcaatttattgtcctcggccaaatacttatcttttttccttgtatctttccatatgacttttatttattaataattagtggtgtgaattattcaacgaaaaaaagtggtgtgaactaactttcttttagaataatcaaagatgtaattactcaagtgaactatgcatttttcaataagcacacgcaaagtaaaaaatacacaaatgatctcatctgtatgtttatatgttaaaacctaataactaaatacattttccttccactaaatcactagattttgattttggagagattttaggccaattctaataatgatccataaattttattttctaaaaggaaattagtttatttttttctttttgttcattttaattatttaggctgagaggccataagttggatgtgctgtgcacaagtgccattcacatttagccaaatattaatcctttctgtttgtaattttttataggaactttgataattactaatttgtagttagaactaactttttattgatataagcgatggtgcaattacttatgtgaattgtacttattttcagacgcaaagtcggaaacacatggatgttcctatctgtaagttaaatcctaatgaataaataccatttccttcatctaaaagaaatagattttaattttcgagatattttactccaatttctaataattatccataaactttcttctttttatttgcaatttttattagaaaaattattaattactattttttttaaaatgattggtgttgtaacaacatatgtgaagtatatctattttcggtgggcacatgcaaaatggtaatacacaaattaatgatcttatatgtatcataataaataaatataatcttcttcctctaaagcaattgattttgattttgaagaaattttatgccaaattctattaataatctgtaaatattaaattagattttgggtttaattttaaaaatcaatttaattcgataaaaattaaggttatatgcatataaataatttcagttagaaaattgccatgtctttcttatatttctacaaatatgagttttaagttacaatttacatgatttatattttctacaatgttgttctttaaataatatcctattatttcgatatatttatgattttttccacgtattttcttgaaaaatcgattccctaattttcaagaatcaagtactttcttgccgttttacataacatgaaccaaacaaccccttaaaaccaaagaaaataaaagagctaggggggaggacacacaagatatacaaccactgcatcataattcatatgattgagggtaaatacgaatatagtatcataatgagcacattataaagaaaaagcgaattggtatattagtgattattacgatagtgaatatactttaatagtttttttttttaccaatactttaatatttggcaattgtttaaaaacattgacatcgcaaaagaaattttgatatcaacaatactactttaatatcaacatcatatctaatttaagttaattaaaatcgatattagataaatctaataataaataaaagaagattaaaaaaagtggaaaaaaagaagataaagaaaaaaataactaaaaaatatcatataaaatataaaaataataactgatataaagttacatcaaatttataattttttttcttttttattctaaaatacaggccactaatctatatcttgttaattgattggacatgatagtatagtttttaaataataaaatgaaaataaatagtcttgttagatgagacatgtgttgaatttgtatgtatggaaaattaaatcgtactcaaagtcgttttgaaaaataatgtgaattcattttatatgcatctatactcagaagaaaatatcactgaaattctcgacaaaataatgtttcaaatatcatcaactacattttctccccctgtcgaggcttacgtatgaaagaaaaggagttttttttttttttttttttttctgggtaagaaattcaccagactggattttactgaacaattggtacgtttagcatttcttccccttcttcagctttctttttaaagtaaacagaactaaagcatctaccatttcagatagacggtgcaattgtccaaggcacgataaaaaaagatacaactattcagaagcacagtaacatgcctgctagtttaaaatgctttaatttaatttcgaactatttttcatcacatgcatcagtacgtagggtaaaggaaatttaaatatatttttttaaaaaatttaattagtaaaaaagaaatataaataaataaagagacattaaaagacattaaaaaatggattacaataagatagtagtgaagaaaaaaataaattacgaagttataacctcaaacgctatatgaaatactactaaaacaatatagaccattcaaataaactcttttatcaaacatactaatttaacaaactgtttttttaataaaataaactagaaagttatttaatctcctcaaatattgagctagtttaaatttttttttctaaaataagtatgttttcaaataaaataaatagttttgtattttctgatgtgtttgtctaaaatatttttatttaaataaatattttttagaaatacaacatatttgtttcttaaaaaatacttataaaaaaaatatttaaaattactttttaaagtttaaacaaactatcatactattttactccttcttctacataatatatatatatatatataaattgatcaataaactattttagatttatattcctttgatattttcgattggacgacgactttcacagttttactaattattgaatttcgaccagtttcctaaaattactagtcaggtatccgttacacatcatccaacccttgacccttaagtaagacatagtctacgatacgaaaccaaaacatgtctcgtacagtgcgtgagtaattttggccattggatcgattttaattttcttcaaacgattattattttctatttttattatttatctttctttgattagcttccctttctaccatttttcttttctctctctcttctctctccgcattcccgtctccacgttccaccccattctcgtcgccctatgtcaccatcgaccatgacgacaccaacacgtttgagctcttctacgacgacggcaatggcaccggctcacaatgatgcaagatatcgtgaagatgatgcaagatatccatagagattttcttctcttgctcacgatgggaggtgcacggtgcacctggatttttctgggagggcaacgcggtggctaggagagggaggggaggcgacaaaggaagatgaagggatggaagtggaactgggtcggagagtgaagggaggaagaaggacaaattggtatatgactgaaaaaaaaagtaaagaaaaaagtaaaataaaataaaaaataacacgatccaacagatgtaattactctggcacgatatgagacatgttttggtctcgtactgtagactccaacattaagttttctccaacattaagtaaacttaaccacttacacaagtcatttcacaaaatctcgatacacacaatagtaaaatcatgataaaatagaccctcttaaaattatcaagtcgataattacaacataatcctgtatgtatttctacatttgacatagaagattaaactttcacactttaatactctttaactatatctcattacatttttacatttgacatagaagattaaactttcacactttaatacatttgaagaatatattgattgattaagatccatggtcaactagtgatatatcaaaataatctatgatttctctttctctctctaactgtttatcaaaatatattttacagtaataaaatgaaatacacgttacatcatatgttcagtaaatatatgatgttataataagagttgttctattctatacctttaaaaaaaaaacaaaatgaatatattttataaagttccatttcataccatcttattttaaacgtaatgtcatttaaatatattttagaaattgaaaatttcaaaataaatacacttgtgatccaacatttattactgaatgaatttcacgtggttctattcatagagtaaaattcaatagataattaaatatagtatcaacatatttcccgcactgtttttgaattttgttacatattactgcacaagatggaaaaggtgataagattaacgattgtaaattgcaagatgtgaggacagagagaagtagaaaaaggaaaaggaaaggaaaggaaaggagtaggaactaggaagcaaagacaaagagagttagatagataggttaaagagttgtggggactcctctggaaatttgggttgcaattggccaaggcaacgcatgtttttttttttttcctctcttaatttttattttcttgcgaaacgcgcacgccagttgcagcagctcgctcgggaaacgcattcattcatcgaatcatggccaagtcaagtccaatcctttgctctctttcacaggcttttgtcttttccatatggtttaattattcatttcatttttaaattatttttaatgatttaatttaatctttaattttgtaaaaaattgaaaattaaattaattaatttttaaaaatttaaagattaaattaaatatttaaaatttaaaattaattaaattatttaaaataatttagacactaaattaataataaactctttcttttatttgttgttttggttttggtggactcgtgcgcgcgcgggaaaatgatagacccgcgcattttgttggttacgcaacaacaacaacaacaacattttcatttcgtgcttatccagaatacaatacattggctttgggtgggtgtggtcggttacgcttttattattgtttctttcaacgcaccaacacctactaataataatatcatatgctcacaccaccccaacttcttcatccaatcatctctcaccttcgacttgcttatttaaatctaactaattagattaccctaaactttcaattagtttaataaagttccagaattagctttattaaatactactaacagatgcaaaaactcattattcacggaaacggaattaaaccttttttattttttattttttggaaggcaaagagtccaaacccaaactaaaaactacacacaaataacacgggggagtctggtctcccaaaatatcagaaactaaaagctgcctaatttgaacatggggatgcacagcacatgtcataatagactaaaccctgccctaatgaatgtgtctcccgtttttaaagtaaaaagtattttttttttttaattctggtaataaacattgacgttgttgacaagtttttatttatttttttttttttataaaaaaaatatttaatctctcatttaaccccttttcgtttatattgtctgttaaatatttatgtgactctgaaaaataaaaataagagataagataaaaggtcataatattttttagaaactaaaacaaatatcaatacttgtccggaaaaatagtgaaagactaataaataggattatatgaaaaaatttaaaattcgaaaactaataatgattttttataaataaagatagaatataaaaatggcaatatgttataatttgaaagatgtaatttagcataaaataagtatctttatgttgtaccattcgtaagttccttagcaaaaaagaaaaatgaatggacactgggctacaaaatgtacctcttcggtcttctgcgtttgcgtgagtgcaatttttcattgattattcggtatgatttgggaaatacccacgttaaatagataatatgcgccttattaataaaaaaatatagaatgtctgttgatttaagagttcgattccccatatttgtgtgaatgtaaaaatattcattgaaaaaatgtagtatttcaaaagatggtttaaatatgcctttaatttctgctatatattgtttctttgtttgatcattgtagtattattattgatttttttggtagaaaataaaataatatttgttatttttaattagttcttttggaataaaatgataaggactaaaagcaaattaatcacatatcacaataacaagcaccaaaataaagaagagaaatcttacattgattatttttaaaaaaaattataaggacaaaaaaaaacaatcaatgtattatagaaataaaaaatatatttaagtctccaaagaataattttaactctgaccggaaaatatacatagtctataaaaagttcatatattgctattacttgttttttttccttctttggtgtatacatatgatgaaattttattaagaataaaacttggattattttgtgtatggtagaaaatatatatgaagacactaaagttaaatatttatgttaattcgttgcattgaaaaagaagtttatagaattaatttttaataatcttaggtattttcaatcttttggtctaaattttatgttctaataaaattaactattcatgtttatttttttatattttttattttatctaaattttaaaatacacacttaatttataataatatatttcccaatttcttgaacacatttagttggcaaccatttattttaacagaaattataagatataatattactaaaaaaataaaatgttttttaatattatgtgaaactgggcctgggcccgttaacagttttggttgaatataacatggcgactaaagaaagtccagcatcacatgaaacgaacaaaaattggcacaaataagatttgggccgatttctctaaaatgttgacgggtagctccttcctaatcggctcattagaatgacaataaaactgcttgagataaaaatttgacaaaacaagaaggaaatacaatgtaatagacttgacataagcagaagaaagcaacaatatcaacaataacccttaaccaagtcactgttgtcctaaacaaatttaagatagaaacacaaagtcattgagtacgttttgcaacattaccaccctttggtctcaaggctattgtgtgtggaccctcttaaattataggtcgaacacttacccaacttcacatttaaaaaacaaataagcaaacctttttcgccctctaggcttgggactaaagagttgtgaaggcttatagattgagtacttactccgtcggtaattataatgggttgagttcatgaggaacagtgaccaaagtactattgttcccaaaaaaattaaccagaatgccacgcgaacaatattaatacccaaagtaccacgcatcctaattcgcaatgcgtcccagcaaattccgtcagttgatgtggtgtcaatctatgaatctagtggccacgtatttcgctacaggtgccagcgaaatacgtagtcaaactgtaaatgaacgtggtatagcgaaatactattactatatattatatttattaactatgatatataattaattttaatactattactatatattatatttattaaataaaatatttttattgaatttaataaatataatgctcacacacatatattttgaccgtacaaatttctaaatgaatctataattaaaattttatgataaatattctttaacaatgttaagttaaatagattaaattctgaaaccaaaaaaagttaaatagattaaattatgtatttcaacataaggaaaaggcactataatattcctatatctcaagagttatattacgatattaaatttttataataacattgtcatttttaattaaatatgtctatcatgtatcctataacttaataatcctaaaataacactaaatatcttctaacctaatgttttaaatctcaaagactcaaacctaaatattatttaacaactaaaactatataaataatatattacaaaaataaaaatacataacactaaattacaaaaaataaaaaacagaaaaatactaaaaaaagaacttacctttcacgctggggagagtgagggaaagtagagaggttatatagtggggaggaggagaggtttatatagtgggccacataggtgtaattcgcttgggcacgaattcgtccatgtctatcacgtgttaccaatgacttttttttattgttgtgtcacgtattttgtgggccaaatgaattatgtagtgttgttatgtgtcctacctgtttatgctcggccaataaattgacgttacattagctgacgaaattcgcttagatgtattctgaattagaatgcgtgacattacgagaattaatacttttgcgcgacattttgattaatattttgggaacagtggcactctgttcacagttcatgaccactagacaccaatagtggaacataaacaacttgagaaagggtaaaaaaatttgtcgattaacccttagtaaatacaatgtatttcgttgaatgattgacattacatctgactctctcaccagaattcctgcataacacacctatggtttgcagtggccggaaaactaaataaattatttcactgaaataagtcaaattaaatattcactaatttattatagattatagtgtcctttgatagtttttcttttcgaaattggcatcaccactcatggtcgagtcagagtggctgatgaaagctttcgtcctttgatagtattttctccccctttttttttatagagaaatcgacggcatcacacgcatggtggccggtggccggtgggtatgcaccaagtggggtttttcttcttcttcgtctctctctctctctctctctctctctctctctatatatatatatatatatatatttaatatcattataattaacatatgctctttcaaagccaacgtatcaatttgtttctatatagtcattattttttgtttatgctaacaatttagggagcttattagttattagcctccgttttacgtacggtgtagtctaataaaagtttgtagggtagcactcgtttaaataaataaaaactatgatagacattccaaagaagcttgcattgcttgctataataacttgcacatcaagaagttataattgctttaaaagagtagaagaaatggatccttcaaagaaacgtaaagtagaaacacaagttaaaaaaaaatgtaaactatatttttcttcattgaaaaaatagagataattacaaataaatgagtaaaagaaatcaataaccccccaaagtaatcatcataatgatttattacaaacagtaacgctaacgcaaatttctccaagcctaaacacgtgctaccaatggaaaagctcataaaaactccggcgaaatccagttaaatccaaatcaaggcttcaccaaaaacactccatctccgtcatttcagtgtcctgtgggaaattcgcaattaccatactctgcaacacaaattcaaaaacacggtttcaacacaaattaaacaaaaaaaaaaaaaaaattaaaatctaaactcatgcataatgcttttaatgcaatgacatggacaaaataaccgttctatgtcgaccatatagggccgagcaatcaatattcaataataaaccctcaatttcaaccttatcaagtatcaactgatagggccatagggcgaaataaacaaataaaacataacatttcttgcccgtagttggtacttattattaatgcatgtttatttaatttattttgatcaggggaaaataggcattttgtgtctcacggcgttttcaagttttttttttttaaaaagatagataataaaagttaggagatagtctgtaaagaagattataaagtaaaataataacacacagatataattatagggataaaaatgagtataaaaataaaaatataactaagtgattatagcagcagtacttactgggaggctgagtgacgacataagcagtgccatcaaaataacacgtgccggatgcacgtgcctttttctgatagtaactgttgaaagcgtaggaagcatgtgcctccaaggtgttaggatcgtaacacgtggcaccaggctgaatgggagtgcaatcagccccaccctctccgcaagcgtaattaagagcgttctgcagcttgttctccgaagaaccgccattcgccacgcaccacgtctggcccttagacgacgtcgtcacgtcaccgttcaccggaacctggctctttccaaccccggacggcggcgcctccgccgtaagtggaatatcataaaccttgttctcacttggataaaacaacccgtagttcctctccgacgtgggacccgttttctggttctcattgaaaagcgcgaagaggaaaacgtcgagtgactcattgggcttcaagggggtcccactcccactcaacacgcgcttaaccaagtttccgttatacgacgccgcattgtccgggctggctccgatttcattagagtccccagcagaaggccaacccgtttccgaaacggcaatcttaacgtcgtcgtatttgagtgctgacaaggcagcaaaaacggcgtcgatttgagcgtcgaacaagttggtgtattttaaaccattacccgaatcaaccacgccagggttttccttgaacagcgcgtagtctaaagagattttatcagagtttgcagcgtaagcgaagaacggataggcattcaccattaggtaagaaccggtttggcggagcaagtcgagcatgggtttgataaccggttcgagaagttcggttttgaaggaaccggatgaggcggggaacgagttttggagcgcggagagtgcgatgggtgaggagattttaatgtttttgtcgaggttgtatttgactagagaagcgtgaacgttcttcatggcgggtacgaggaactttgtcgtgttgtttgggtccacgaacacttcgtttcccacggctatggcttcgatttgcgtggcggggtagtagctggagatgttggcttggacccacgcgtcggtgaaggactgttccgcggcggctttggcgagaagctcatttggcatggcaacaacaaccttcattcctgagttggcaaacgcggttaagacggtggcgtcggtgtcgtagagcttcacacggttcagcccctgagtcttcagaagctccaccactttcgccggtgtaggtaggtcgttcgcaattcttccatagtttattccgattgatcccgcttctgcaaagcacgtcagaaagttaacaactttcaaatgcaaaatgaaatgaagcaacaaaatatacatgcagtttcataagtgctattttctaattacaaccagagttcatcttggtaagacgaaattctaatacaaactgaaagaagagtagtgagagatgtatttacctgatgatgaagaaaagaatgagataaggatgaagaagaaggagaatgtgagaggagccatgctctgtttgagagagaagcagagcatgcagataattagagaggaattaagaaaaagaaagggtgcagttattttgtttgtgagaagagagggtgtggaattttatagagtgattggggacttagtgggccaacgtggttgaaggaaaagagctttcactttacaccgtgtgggacccttgacctgtgttggagacccaaccaccaatgcactatctcagagccgctaatgttaggttagaaaaaatgttactacttgcggaagacaaatgtttttttttttttttttttttcctgtatagaaaaaaaaagagttagaaaatgttagctgaactgtccgttggatcatgtagtaggctatgttattgaccgtacacgtgcagcgtatcgtttgggacaacgttgtcgacagggacacgtctcgaatggaacggggtgaggtcgcgattgccaagggacatgtttggttctatagccgagaaaatatattattattggcttgattttcgattgaaacaatgatgaatttacggaaacagggccaaggtttcaatgattttgctcaaatttgaacgttggactttgccatccagccgtgcttgatttgatgacatgtgcattctctctgtttttgtttcttctgggtaaaaagaaataaattgggtgggaatcaattaattcaggactatatatataataattcatcaattctctcggcaaatgaataatactataataggcatcatcatcatgacagagtaatactattattttatgattttatcatttgctatgggattttactttacttcagggttacattcatttcttgctgtagatttagagatctccaaatcaaagtttgttgaatgatttttaaacgaagaaatcggtttttataaattttttattggagtaaatttatgtaatatgattttaaaaaaataagatctgtatttttataagaaatcatttcttaacaataaaaatactaatatttatctaatacatatcagggattattccaaaactactttgttagttgtaacttattttaaaatatgtaattgttatttaaaattaaaataaattgtcgtaatagtttatataattaaggataaaaatatctaaaaaaatgagattatttattttataatgcttatagataatgagtttaagtagttattataaaagttttaaagaaatcacaccgtgaatatgcattcaaattaaattaaattaatatttaattataatcaaggggaaaaacatgcatgtttagttttaggttagaaaattaactgtagttctaaaattgattttagataaattttcatatatttaatttttttataaaaaaattgaaattaaatttaagttctaaattgattatgagttgaaataattttgaataatttttgttttagataaaaattataatatattttatttttaatttgattttatagtaaaagtattcaaatataaataaaatttaaaaaataatttccaaaataaatttgataaaatgatttgtattcaaaattagttttaatctgtcaccgtgtatccaaataggtacgtaattccttaattaaacaaatggtgtagatcagatcaaatgaagttaaatctaaaaccaatgaaaactacaagacttgtagaacatttgaagaggacaaactagagtctgtttgaatataagattaaaagtattttttgaagtttttctactgaaaaattactatattttaaaaaaaaattctcaaaagtaattatggtatgtatctaaatatgcccgtaatgatgaagacttgacaaaggagaaatgcagcaggatcgatcaataatcattctcctcgtttggcaacgggaaatgttggtaattgatctgtgtgtttccttctgatttcattcatcccaccacggaatggtatagccattaattaattcgaaatgatagggattttatcttagtcaaaatctcaaaaggccgtgaaagacactactacaccatcgtgtggaaattccatctttttccccacgagtttcatagaaattttacttgaggaggataataactaattccttgagctaagcaataaaaaggatttctatacattttcttattagttattattattaatgtgatttctatcttatatatttggtggatagttaaagaattaaaagtacagaaaaaaaatcataatgtcaacaacaaataaattattccataattttttttattgtttaacttgttaatctatgtactacatatatagccagtacagagatattagagtaagatttttcttatgtcgaatacattatcagagttttttagacaaatgacatgccaaaattcaatctatgtactacatatatagccagtacagagatattagagtaaaaaaaaattatatatataccattaattttgtttatttcatgtgttgtcaaattaattaaattgtataataaaatatattaaatgataggataaagttttttagacaaatgacatgccaaaattcaatttttgtcctttgattatgatatgtatttcaggattactaacatttaatttagtgaccctatgaaaaagaaaatgagtaaattttcaagtgaatgcacctttaaatagctagtgaccgataaattaaccctaaaataacgactttttttttgtgcagcctgaaataatgacttttgggtagggtgtaattggtatcggcttaatttggccccaataaataaatttacatattttagtattaaaataatatcatttgatggttaaattattgtactgatcatttaaaagtcagatgattatttttaaaaataagaatctttaaaaaactaaacagagattgatgctatcgtcattgatcaaatcctcatccaaacgtatcctaaaatagcaacatatacaaccaaaaactcaagttgctccgttatttttacttagtttgtcctaaatgtcatattttcaaagggttttcatttaacattattttagtctacataatcaaaactgccaaatgattgtcacaccctatatccctataaacaaaaagaacaacactaggaaataataattaatgttaaaatattttatatttatccatttttatcatcttaattaattataactaaatttatttcatttgtcatactaccgtatggacaaggtttgagaaacaaatgagaaaagataaaatgacgtgccattagcaagaagaagaaaaaaaaacagaagaagaatgacgtgcgattaatactttttatacagaaaaaattattgtgccgtagattagtcggtgaaatgccccatttttccatgctaacacaaacagccaactagctttgcaattatgaatgatgcaatcaaatacgtatgggggaccttttgctaattgaaaatgcttgcggacgaaggtagtagtaattaatactttggtgccaattaataaaacatcaattttagtacttgttttctgcagccattttatccttcaataatattattaaccataaagaaaattaacaataatggcagccattgaatttatttatcgttgaattaaccaaaggaagtggtcggagttggagggcattttctttctttcttttggttcaactctcaacgccacacatagggcgttggcatgcacaaaaatgaagatcaatttgaaggtcccatttcaggtcgtcacagtcatgtcattattcaaattcaaattaagtaaaagggacttgttacagaaaaaaattgttagatgaaagatatatttttatttggcacatgtattgaattaatttaattaatgatcagcttataaattttaaaagatatatattatcgaatggtagttatcaacaaatcattagctgtatattttgcacactaaatgaaccttttattttaatcaagtcaaaattggtttgtcaacttgcatctttccaatttcacacaggtatcgtttactttaaaaatcttaataataaatagggagctaagacgtttctacacttaaactctcaggtgtactaaaatatgataggcgatttggattcgtaccctcattaggtcggtaagactcattcatatatatttcataattcatagttcatagtgttcaatttcttaataactagtgttacattagatataattgcatctggtacacttggttgtccaagctaccagtctaccacgatatgtgatggagaataacattaacaagaagtaatacaaataaaataattagtagtttatgtttgtcatcttaagtttttttttttccttctaaaaattcattttcaacaaaagtagaaataaagaataaattaatagatcattcatgctaagcttagacgatctgtaaattcttcaattaaaactggagattttaggtgaattcatccctaaaactatacataagcttatatgggcaatttttaatgtctttatgatggaggttcactctacggttttctggttggttcacttggacaccaattttagcttgctagggtttgattggggcactgtggtggggatgaagatttttttttttttttttggagggagaggcttttgtccaaccatttgaggagggagcattttattgttcgataaggacaaggagatctcaattgatggattgggtggaagtgggacatgcatatatcataatgtagacgttatgtttcatatttatccttgtttctagccaccccaacagaaaaaattggatttatcttttccatggcttcaggcataaaactgtatttgtaaacctaagtaactcgttcaccaagaacataaacgatagaactcatctttagctgtgaaatatttggttagaaaaaacagatatataacttttcaaactaaaaccaaaagttagtttagaaagaattaacttcagggaacaaattatggcaatatattgaactagaggattaaacataaacctatcaatatatttaaaacaatctcatactgtgctataaaatcttaatctttattattttcattctttgatccccctccctacctcctcccccctccccccccccccccccccccggcaaaaaaaaaataaaaatcccgaaccttttacttatcttcccttaaaataatatatacagtgtaaattttgggtcatccaaattcctggcattgaattcaatcttcattgtgctggagtgagaaatagatgtaaatcttaatgggaaagcattcaaacgcataggattttgtatttatgattttttatacccgaattagaccaagaagccataatcatgtaaatcataatgtggaagccgtgaaacagagaatcgtgaaagtcatgattgtccatatcctgattaaataaaatcataagcgtcaagaacgtctttgagtataattgatgaattggtttttcttccatctcactctttttgacacacatagtacggaagatttttaagagcacaagtggaaaaacttaacgtgtgttttaagggagagaaccaataatacgttcctcaagtattagaaccaatggatgaagtcaatttaatctttaaaaaaaattcgatacaatttaatttaaattttaaatagtgaacaaatacctcaatcttatcagtttaggtcactgaaggaaacttacaaagccataactttccaataaaggattgtgttacttgtgaaaggccagacttatttcaagtttctcttttaattcctgtatctttcgggtgcagctcttttcattttttttggtccacggatgattttttgtttttggtcattatcagtgtctctcttagttcatgttatgaaatcgatttcattagggctattacatcttgcagtcccactattatatcatatacctcgtgttgcattctgaaaaagaatgtaaatgaccattttgaaatagtcttttcagaacataatagaaggtacaagatataatagtgaaagttagagtataagaaataaatgccgataatgacccaataaataaaactgttattcgggtaggcctctagaattatgattgggagttgatattcagaccctttttctgctcttcgcaccagctcctttttttgtattttttattattactaggagaaaacaggcaaactgtttttccattttctttgaataaaaagaaagataataaaagttagtgagtgatttgtgaatatgattatagagataaaacaataatttattattgtagttattaaaatgggtatacaaatttatatactaaagtaccctatttcctttatatatagttatagattatagatatattaaggaatattattcttgtttaaaagatattatttgtttcttatgtaagaacaaagtattttaccctttaaatattgcgttgtgatctcaggtttgccaatcttgtcccacttacccctttgcacttattagtgtttctaagattcttaagcagatgattagatcaatgtttttaaatgttgttcatccagggtgccctatgataatttcgtccagaactgccctttcaaacgtcaactccaatttacagaataagggcaaataaattttcgaatgttactccttggtttctcacggttcagtacaggtgaaagaaagttttccacatcagtcaaaaggatactcacattagcttatttatcataagcaaaagcgttaaaattgaataatttcagtttcaccacatacacaacacacgtacaacagaggcagtttcaaacccaataaagagcaatgcacttgctggctctttgtcaaaaggagtgcataagagaatgcacaggtgacatgtatagcattcagagtttgcttcctgcaccctcttgcattaccaagcaaaaatatgaaggtgcaagaagtttcactcttagatccaaatggaaagtggatagcgggcttagctttggacttatggtccatcaggaagacgggcatgtcccaataacacgattattaatgtaagttggtcttccataaaaaggctcctactatttacacccacgttttctaacaaataggataaaaataagactaacaaatatgagtataatataaatatttatcatttatttatttatttattgtaaatcagcttaattcttaagtgatattttattaaaaaatatatacttattctggaagtatatctttataactatgaatcattgttagggaaatacatttacggaatgtgtatatgtaattttggaaagacatttttggaaaataaaaggggtatacttctttttataatgagtaattgagaggtaggaagggggtgtctggggtgtaaatagcaagagcctaaaaaaattgtgagttgagtttagcatcctaacgtataatgtagaagattcacaaatatattttatccaaataatttgtcctattcacatttgacgaattgaagttattattatttttatctcataaagacattaaatggttgaatagcttttgaagcagcacggatccaaaaaaaaatcagctgtagaaatattattcacatatataattaactaggaacgattttcatattatagttttttttcactacatttcaaattatgaaagcattttgtaactatacatacattgagaaaaaaatctggtggtgcagttgggcctaaattgaatccgtccctgtttttaggttataatatattacataccattcaatcaagttgagtataattattgcctagacttagcaagcttacccaaaactatattaaaatggttgaatagcaagtgagtataaaataggcattagggtaaaatttaacgatatatcattagcacaatatcatgtatattaaaaaggattactgtgggaaaaaaaatcctattttgaatgactaggcaataatgtaaatatttatgattcaaaaataaattttaaagaaataagaaatattcacatctaaattacttttttctttctttctgaattcacacctaaaatacttaaacacgacaatagtactattttcccttcttttcttttcttttcatttccggctaattaaactagttttttttttttaatagagagattcctctagttacatatgagattatatatacaatgtattttctctatttcaaattgattaacgtttacattttttcccacataatttaggaaaatacgtaaccatttgtgtaaggcaacatattaacaaaatttgttaaatatttaattgaagatcgataaaaagaggcttttcctatttacccccgactaaaagtaaccaccctaaacaacaccagacttagtagctaaaactatcacttgcacttaaccccaaattacctaaataagagtaatatccaaacttaactaataggataccctattacatctggtcacgtgatcttacacgtggaatccaacaaacccaactgtctttctcgctgaatatgcctatataggtgagtttttcttaggcatgaataacttcactcattcattactctcatagacattttgatttgatcgtgagaatctctatgagtaacactaccaaagtcactcatcaccatcatgaattattgtgccattgccctgattcatatccacatcacaacaataataaaattgcacaattataatattagagaatacgatttatattgaaaccttaaaagatcaaaatgcaccattataatacctaagataggaaaagtctaattaagctaaacataaatagaaagtttaaccaaagggaaaaagaattaatcaaccggaccgagggtttggaaaagtgaaatttggtattgtttttgtaatgaggcattcacatgaataaagttaccttccatgaatttgcttacatacacaggtagttcagttctttcgttattgtaatgtgaggcattcgcatgaataaagttaccaaccatatttttgctcacatacacaaaggcattaaaaaacaagacacatccagagatttttacatacacaaagacattaaaagacaatacacatggcacataccgttatgctagcatccaagtgagaattgattgaattcctgaaaaataccttttcaaacatctcgggctccattctatacattagcaaggctaagaataataagtttccttaccgttccaaattgaaatgtataataaagccgttcaattacacagaaaattcacccctatcatgtttctcacgcgcccagcttgattaaaaaatatattttctttacattctattctattaagctgtttgaatttgtttacaaacaaaacaaacgagagaccaaatgcactagccaagaccctacgaaaacgacaccgtaaatcgtaaccccataacactagacacagcatatataaagagaaacaaagatatagcatatgggggagagagagagagagagagagagagagagagagagagagagagaaatgaagaaaggcaatgttcaaaagaacaatatacggtgttcgacactatacattgctttactctctctcatcacaatcttcattattcccttttgtgagtccttcaactatggccaagccctgtcccagagcctcctctatttcgagtcacagcgttcaggtcgcttaccctacaatcaaagggtcacttggcgtcaccattctgccctcactgatggcctagaacaaggggtacatacattacttcatattaatatattaaccttaaactatgttattttccttttgtgctagcttttcattcattctaatattatggttattgtttttttgggcacgtaggtggacttggtgggagggtactatgatgcaggggacaatgtgaaatttgggttgccaatggctttcaccataacactcctctcatggggtgctatagaatacggcgaacaaatcgctgctgccggcgagtatgctcacgctctggagactatcaagtggggaaccgattatttcatcaaggcacacacacaaccaaatgttctttgggttcaggtattaatttcaattccagtgaatttttttttttttttttgaaaattgattacccacgcgccgccgttgaaaatgggatgaatgattacttcttccaagctaaccggaggaatagatttaaatgtcggagctgtcaacggattcgtccgcaatctcgccgtgactggcgcgcgttatcactcgcagcttggcatgaacacagaattttgtaaatgagatttgttaaattagagtatctaaaaggaaaattattatgtaaaatccggtcgtctaatttcaattaatcatgggatatgttatgaatttttttaataaattaagaaatgtaactatttatacttattacataaagattattcgacacccaacgtccaattaaaaaacataaagatttgtcggagattataatatcttaaatcatatagtaacaattatttttaatatattaattagaaattgtgttactatataaatgcaaataatgagtaatgatatacatatacttatttattttaaatattttatccaacatttcttaattctttctttatatcaatcaaattataaattctttcatacttataattttttctttttttcaactctacctatctctaggtgtaagataacatgtttatcaaacattgtccgcaaataatatatttttaatactgtacgttatagatttcactagtttaggattcagacttgcaaaaatgacaacaacatatttagcgaaagatacagaaatttcactcaataaaaaagtaaaaaagaagtgtgctacggtaatgaaatgatgaagatgttaaattcctttataaaagtggttatatgtgtatatttggtcttatgagttaaaatgttcaggcgggtgacggcgacactgatcactactgttggcagcggccggaggacatgacgacatcacggcgagcttataaggttgacgccaacaaccctggctcggatgttgccggcgagacggcggcagcattggcagcggcatccattttgtttaggagaacaaacccacattactctcaactacttttgcatcatgcacaacaggtatatgagttagttttattgacaatgttacgtagttatggattaatttaattaggattaatttcaatgggttgttgtgttattgtagttgtttgagtttggtgacaagtacaagggccagtatgatgagagtgttggagtggctaaagggtattatgcttcggttagtggctacatggatgagttgctgtgggcagcagtttggctatatagggccacccaaaaggaggaatatttaacctattttttggagaaggcttatgactttggtgggaccacttgggccatgactgaattcagctgggacgttaagtacgctggtgttcaagccattgcttccatggtaattccctcacacttcccaattcaaagagtcacttcccttctttattgtaaattgtcaaaaaaggtgcattagaagtactatactcactttgaaaagaaaaaaaaaaaaactaaaaagcactatactgccagtattattggaccttagttacatattatggatcatcattgatttctttatacatatagagagaggagtgacactctttctcacacttttttttttatatatttgttttataattagttaaaatttatcaatttttacaagttttatttctcatctaatataaattaggagagaaaaatatcaattaaaaataaatactattaaaattaattatttcaaaaaattttaatcaataaatattaaaaaaagaatattaaaaaatgtcattagcatttctctctctctctctctatatatatattttcttcagggtctagcattagcatagttggattcaatttacacgagaataaatttttaaaatatctttagtgatagatttcaaattgaaatattatatcactttttgtagttttcttaaaatcacataattttttttttagtattagatctcattttgagatcttaagaaaagagaaataaaaaatttcttcacatattgagggttcttctataagaactcattctttatgttaaatatctcttcaactcctttatcagaatatctagtgaatatcagatattaagttcaaaatctttattcaagatctatcactaaaaataaattttaataaattataaaaaaatgtttaaaagagtacaagaaagaatgtccctgtcattcatgtaccgtaaattgcttaccgacatttttccttttaacagttccttatggaagaaaagaagcacaagaaacacgaagtcatactcaaacagtatcgttcaaaagccgagcactacctatgcgcgtgtctgaacctcaacagcgttaataacgtggagcgcaccccaggagggttactatacatccgccaatggaacaacatgcaatacgtagcaacggcgtcgtttcttctcacggtttattctgatcaactcctagccactgatcagaagctgcattgccaaaaaggggaggtgggtccccatgagatgttggccttggcaaaatcacaggttgattatattttgggctctaatccaatggctatgagttacttggtaggctacggtccaaaattcccgcggagggtgcaccataggggcgcatccattgaatcatatggggaaaataagggttttattgggtgcactcagggttatgataattggtatggacgtgttgaacccaatccaaatgtactcattggggcactcgttggtgggcctgatatcaaagaccaatttaaagatgagagacgaaattacgttcaaacagaggcttgtacctacaatactgcagcactagtaggggtttttgctagattgcatcaatcacatgcacatgctgatgtttattacaatgaaacccctttggtagcttctagctaattggggttatagagaattttttttggtccattattccgggcaaagaatatttcttaacagtgcttacttaatttttgcactgccattgtaattgtagtttgagtatattagtatatagtaagatacaaactatacaatcaatgttgacgcagaaacgcgtctagagacattaggtggaatagcaatttgcaccacttatagttagcctagcaattggaaagagttgcattcgtagttaaattagaaggttctgttcttttgggttagtagttaaagacttggacaatttataccatgtgcttttattttttgtcatattttacgactttatttaaacctaagaattttaatttatcacaaagaaaacaaacaaactaaataattaaaaaacgtgaaaatttagtgagtttcaacgtcaaaaaggacaattgagagaaaagttttaagtttgatagattggcaacctaatagtaatagttgcagctaccgacacaaaaaggcaagtgtcatttgtaatacttggagcatgtaggaagggagatcgaatataacactaaattgacaatactatatgttttaaaaaattcacgagattcttgggtgtttccatttctttcttcataactctgtttgcttgtcttctgattttccattcttcccctttaattacggttgcaacgaacggcatgagctaaaggaccaaaagcacttttccttgtaaccgaatttgcggggaaatggtctcgcatgaggaaaagccacccaaaacgaaaatcaagcaggaattagtgccacgacgttaattcaaatgcaagtatatttattggtcacaatcacaaggttcaaaatgtggaaacccagcagcacaagagaccatgttcccatttattagtactacttcattttctcattcccgattggtcgacgcgctctgttagcgcgtggaagtgtcaacacggttggtacttttcactttaggacatttttaaggaagcgtgtgtttgtgtgaaagtgtcattttccgtgaagcacaattaatactagatttacatcaagaatgtttgaatgtcgtaaaaggaatactagtagtgcagtagcgaaaatgccaccctgcagcaacgacactatctataattgggataatttaatgaacagcagtaattaattctgcaagaaaatcaggaaaccataatggcaattcgtgatcactcagggcactcacgatttaagacagggacttttaaagattccggaaatttcatcaaaaccacgttaactcaagtagcatatgttaagacaaaagaaaagtagcatatgtgaaatataaatcagaaaaattccagcaggaggaaatttatcaaatgttgaaaaaaattgcttggactatactctttgaaactcgttatttaataattttttttttggagtcaagttgaaatcaatataggattttacctattaataataataaaaaaggcataggtagcacttctcgatataaatgcaacaaattaacactactagaaaactaaaagcttgaacgataaaagaggcgggggggggggggggggcgacaaaaaaataatcaatggaatacttggtaattgaaaattttaagatggtgaactttggccatttagttccatctactaatttttgcaagtcgtgcatatttatttatttttctcgaagaaaaccttagaaatcaatatatttttataaggaaatttctatttaagttttttgtttgggggagaagttaaaataaaggcaagaaactcaaccaaacacatgtcttggcccaagcctagtgagtacacgagatgcacaccatggcatcgagttcatttgttttgggcattatgccatggcccaaagcaaaacctgctgtgacctgaatcttcaatatatagtactcgaatctccttattttaggatcttaacaatgcattgattctaccgattttaccatcgtacgacagggcccctgatccacgaaacaaaatgctcattctttagttctatgtcactgaataataacccaatctatattggatttttcattaatacacagcttgttgggtaatcacggaccctcaaatatcaaatgcggaagcggaataaaatcaaatgaggagcgagagagacaatcaaatagttttacgtgggagaaaaccttcttcaacacgaagaggaaaacccacgggaccaattccagatcaaatattcactataacaataatgggttacaatgaatcaaatacaccaatgtggtggtacactcaatctctcaaacaatggtgatcactcaaactccctaaagtgtttcactcaaactctctctagagatctctcaaatatgcacagcacaaggcttgctcaaatactgcggaatctctcacgcagtcaaatatcaaatggcggagtatctcaacgccctctcaaatatgcaaacatgaaggcttgctcaaatgtgctctcaagactgtcacttgaggctctcaattttctgtgtgttttgccttcacccttgctcatctatttatagggtgaaatggactgggctttaagccatcaaatcaaataagattatatcttatcaattaaaagatatctattatatcttatcaaataaatattttctcaaataaatatcttatcaaataaagataagattatcaatcaactaaaaacgaaaattatccaacaaatctcacccttccgtttttcagtgagaccagggttcttcaacttcaacatcaacatcccggccttctttctcggcttcaatgtgccgaattcattagcccggctccttcacagcaatcttcaaatttccatgctggtaccggcttggtcatcatatcggaccaattcaaatcggtgtgcactttgccaagtattctgcaacgtactcagcctcggtcgtccatagtgccacacacttctgcaatcttgattgccaagagactgttcctccaacaaatctcatcaaatatcctatcgtcgattttctcgagtcggaatctccccctaagtcggcatccgagtagccttgcatctcggccaactcataagtctggttttcatgcagggaattcgtcacgtcctgcatttccttcttggggtatctcggttgttcttcttcaaccgttgtagaactcggttcatcaccccggttctcttcatcaactcggacctcaatatcttggtcctcatcagcttcttgctggagatcatcatcttcagtttctccccctgcttcagtctgcacaagagggacgggttcttcacctcggtcacgagggcagccgggttcttcacgtctgacagtaacccgatcttggagcttcgagatatcatgaagagtctcatcttcatgaaagatcacatctcgacttctcactatcttcttcttgataggatcccacagtctgaacccaaactcggttttcggcgaaccaaggtagatgcattccttcgtcttctcatcgagctttgccctttcatctttagggatattcactaaagctcggcatccaaacacctttaggtgatcataggtcgttttctgtaacgtcccgtatgcatccggttcattaacattgatttatggtcattaagcgcagcaattatcacagataattaaatttggaagcgataaacttaaatgacatcatcaagcgtcatgaacaaccactgtacatcatatatggtgaattcttataatatacaacgtatatttcaaaactatacaaaatccctatcaggatacaaaataacaggcatgtatcaaaagatagagccaacatgctcttaaacactatgcctaaggttctcacagaacctatccctgctcgggcctcttgccctgggatctctcagcagctccctgagaatcacctgcaaaacataacccccaacaggggtgagataacaatctcagtaaactcagggtccttggaggtctttcctccccctggttcagttccatggcatataatatcaaaattggcattttaaactagtaatcacagctatcaagcaatattaccacacatacatagcatatttacaattatgtatcaaggcctgaggaggcattatccactatgtgggcacatctcacttggaggctcatccactatgtgggcacatctcacctggaggctcatccacgatgtggacacatctcacaacaggactttcatatatatattctatcaaatataattctactggccagagaatctcatcaatcacatatacaacactatcacagtgttcaactcatcatatgcatatgttcataaaacaataatcacacaatttcaatatacatgcatcatgatatacaataaccatcactccctcggagtatggtggaacacaacagtgggaaacactcccaagaacaaagagcttacctgctctcagcgctataccggctcttccggtttcgtggtcacaaccaccagcaagattactatcacgccctacacaagacataaaacaatcaatcaataacggtccttagccgttagaatgaaaggaaatgccattcccttccattaaaacctctctgttctctatcttaggattatcagagctaaccaccttataggtgattcacagaccctcaacaggatctatcttggtccaaccaagatcttagagtccccttagactctgcataagctcaattcaatgatctactaggtcatatatcaacaatttttcaacttggctaaaacagctatatcaacacattttcaccgtttatttatccttctgaacaacttttgtaaaggcacttaggctcataactatcataatatcttccttttactcaacatttttcctacccatacctatctcagggtcaaaaccaaacttcatcaaaaatcatgtttcaaagtttaatattcatcagaacaacctcctgagcatacttttctaaagaactcaagcctaattctagccctatcacaaaagggtcactattcaccccaagaacaaattctcaaatcaatcggtaaaacttgtgtttcttacctctaaatcgacagaaaaggctagagaacagcttttccaagcttgaacgtccttgaaccgccttcttttctcctcagaatcaaactttgtgaatttccctagagaactggatctctttgtttgatggttttcagagaaaagtgatgatggaatctagctcattgagtagttcctttcaactttcatgttgggtgtgaaaggttttggtcaacggttgagtgtttaagaagcttctctagttcatcaatggcagaagcagagaaaaggaagaaaggaaagagagagaagggctaagggaaagagagagaaagagagaggctgttatattcaccccacctttttaagaattttgtccgcaaaattcaaaaacatacctgtcaaacaactcggggtatagctgtaccagctcctgctctcgctcccaagtcgcctcctcaggtgtcctcccttcccattgtaccttaactatgggaatggtcttactccgaatctgcttctccatcctatccagaatccgtataggctgtgtaggacaagttagattctctcgaatctggacggtgtcaggctccaccacgtgcgacggatctggcacatacctcctcagctgtgacacgtggaaaacgtcatgtagccctgacaactggggaggcaaagctagcctgtaggccactgatcctactctctgaagaatctggtaaggaccgatgaacctaggactaagcttcctcacacccaaagcgcgtccaacaccagtaactggagacaacctcagaaacacatggtcgccctcatcaaactgcagcggcctgtgtttatgatcataataacttttctgtctactctgagccttcaacaacttatctctgattaaacggatctgctcagtagtctcctgaaccatctcaggtccaagaagctgtctctcacccacctcagtccaacatacaggagtcctgcacctccggccatacaatgcctcataaggtgccatacctaaactagcatgaaaactattattatacgagaactccaccataggtaggtatcgatcccatctagtaccttgctccaaggcacaagctctcaacatatcctccaaagtctggatggtgctctctgtctgaccatctgtctgaggatggtaagctgtactaagcctcagctgagtcccgaaagccttctgaagcgtactccaaaatctagaagtgaacttcggatctctgtcactgataatactctctgggacaccatgcagtctgacaatctctctgacatatagctgagccaacctctctgcagtatagtcagtccgaacaggtaagaaatgagcagacttggtcagcctatcaacaattacccagatggagtcacatccactctgagttctcggtagtccaactacaaaatccatggaaatgctatcccatttccactctggaatctgcaacggctgcagtaggcctgacggtctctgatgctcaatcttcactttctgacataccatacatgtagacacatactcagctatgtctctcttcatccatggccaccaaaatctccacctcagatcctgatacatcttggtggcacctggatgaatgctaaactggcccttatgagcctcagacagaactgcatccaccaactcgcccttaggcacaacgatccgatcttggtacaacaccaagtcatgagtctcccaggaaacatcctgttgaccaatcatggccctcacatcatcatcctgtttctgggcttcccggatcctctgaattaactcgttatcaatcttggtctctctcaactcaagaccactagcaccctctgttacagtcaggtgcatatctctaaactgctcaatcaacttacagtctgagattatcatgcaggcaacactcacatgcttcctgcttaaggcatcagcaactacattcgccttgcctggatgatatttcaactcaaattcataatctttaaggaactccatccaccgtctttgcctcatattcaactccttctgatcaaacagatacttgaggctcttgtggtcactgaataccactaacttggcaccatacaagtaatgcctccaaacctttagagcaaagacaatagctgcaagctctaaatcatgtgtgggataattctcctcatgtggcttcagctgtctggatgcataggcaactaccctcttctcctgcatcaacacacatccaagtccccgcttggaagcatcacaataaacctcaaaacaatcctcaggatcagggagagtcaatactggagctgtggtcaacttttccttcagtctcaggaaacactcctcacattcatgagtccaaacaaatgggctacctttcctggtaaggcgggtcaaaggtaacaccatctgtgagaacccctgaatgaacctccgatagtaacctgctagaccaagaaaactacggacctctgaaacattcttgggcctttcccaagacatcacagcttctatcttactgggatcaactgctaccccagctgcagaaatcacatggcccaagaatttcacctctgaaagccaaaactcacacttagacaacttagcatacagctgattatttctcaatgtctgcagaacaatcctgaggtgatcggcatgctccgcctccgttctggagtaaatcagtatatcatcaataaacaccaccacaaactgatctatgaatggtctgaataccctgttcatatagtccatgaacactgcaggggcattcgtcaaaccaaaggaaatgacctgatactcataatgaccatatctcgatctgaaggcagtcttcggtatatcctcgggcttaatccgaatctggtgatatccggatcgcagatctatcttggagaacacacttgcacccctcaactgatcaagcatatcatcaattcgaggtaaaggatacttattctttatagtaaccttattcagttgcctgtaatctacacataaccgcatacttccatccttcttctttacaaaaagaaccggtgctccccacggtgacacactcggtctaataaaccccttggacaacaagtcctcaatctgtatcttcaactcctttaactctaaaggagacatgcggtaaggagctatggatatgggtcccacacctggaaccaagtcaatggagaattcaatccccctatccggcggaagctgtgtaatctcatctgggaaaacatcaacaaactcactcaccatcggaatctctgacatatccaacccttgtctctcatctgctgtactcagcaaaagatagccctgagctcccctctccatctccttgcgagcttgcaagaccgagagaaaagaaatggcactcgagctgacttcatctgaaggcactacaaccttcttataacaacaatctagcatgatgccatacttggccaaccaatccatacccaaaataatctcaagggtaggcatcgtaaggcaatacagatcaacaacatattccttgccctcaaactgaaaatgcacatctctgcagtacatatctactctacattgctccttagaggcggtgataacctccataggagaagaaagtctgaacataggcaagttcagtcctagagcagtgcgatcactaataaaagagtgagtatctccagagtcaaataagactctcacatcatacacatcaatcaaaatagtacctctgatcaaatcaggaggtctggctgcctctctagcatccactgtgtagactcgtcctgcagtaggtgctactgatatcactggagcagctatagcccgaccgcctgcctgtggacactccctagcataatggccatgcttgccacatttgtaacataccaactgaccagtggaacacactccccaatgatttttcccacaagtagcacacttgggacgtggacctggtctcggtgaccctcctctctggctggagctcttcttgaatctatctgctggagaagaaacccccaaatctctgctcttgcccttcccagtagggcctgatccactgggtctcctcatctcctgtctctcagaggaaataggctggctgccactgcgtctcctaatcatatcctctacctggcggcactgtctcaccaggctgcccaagtctcgagatccactgccagctatcttctcctcaatactctctctaagtcctctctggaacttagcagcaagaacctctgcatcaggtagagccctcctgaaatgtgcatatttagccaactcattaaatttggctaagtactcatccactgacattttcccctgaacaagaccctcaaactcggcctgcttctgctctctggcatctctggggaagtatctgtccagaaattgagcttcaaaaacctgccaggtaataacttcaccctgacctctcaataactctgaagtggtaacccaccactcatgcgcatctccctgaagcatgtatgtagcatagagaagtctttgatgatctgaacattccatcacagtgaagatcttctctaaggcctgcaaccatctgacagcagcaataggatcatattccccatgaaaagctggagggtcatgcttacgaaaagcaatgagcatcttccctctagcagctgtatcctcctcaacatcagcttgggacaaccgtcccctctgtggtgactaggcccatcagaatgatgactacctccaccctgctggcgactaccctcgccctctggagtatgctgtgcagaagatactctatcctctctacgcagagatctcaactctgccatcaactcctcattggcctttgccaaggcctcattcgcctgtctactcgcagccatctcatgctgcatagctgccaaggcggctataactgggtcgggttgtccatctgcacccgtcgtctcactattgttccgggtcctcaccatggcactgcacatgtcacataaaagggtgagttgatcaggctcacactcaataaccacacatgcaatagtcataatgaacacctagaccattagtgaacaacacacaattcaccatacataatgcttccctataaaattgctctgataccataaaatgtaacgccccgtatgcatccggttcattaacattgatttatggtcattaagcgcagcaattatcacagataattaaatttggaagcgataaacttaaatgacatcatcaagcgtcattaacaaccactgtacatcatatatggtgaattcttataatatacaacgtatatttcaaaactatacaaaatccctatcaggatacaaaataacaggcatgtatcaaaagatagagccaacatgctcttaaacactatgcctaaggttctcgcagaacctatccctgctcgggcctcttgccctgggatctctcagcagctccctgagaatcacctgcaaaacataacccccaacaggggtgagataacaatctcagtaaactcagggtccttggaggtctttcctccccctggttcagttccatggcatataatatcaaaattggcattttaaactagtaatcacagctatcaagcaatattaccacacatacatagcatatttacaattatgtatcaaggcctgaggaggcattatccactatgtgggcacatctcacttggaggctcatccactatgtgggcacatctcacctggaggctcatccacgatgtggacacatctcacaacaggactttcatatatatattctatcaaatataattctactggccagagaatctcatcaatcacatatacaacactatcacagtgttcaactcatcatatgcatatgttcataaaacaataatcacacaatttcaatatacatgcatcatgatatacaataaccatcactccctcggagtatggtggaacacaacagtgggaaacactcccaagaacaaagagcttacctgctctcagcgctataccggctctcccgacttcgtggtcacaaccaccagcaagattactatcacgccctacacaagacataaaacaatcaatcaataacggtccttagccgttagaatgaaaggaaatgccattcccttccattaaaacctctctgttctctatcttaggattatcagagctaaccaccttataggtgattcacagaccctcaacaggatctatcttggtccaaccaagatcttagagtccccttagactctgcataagctcaattcaatgatctactaggtcatatatcaacaatttttcaacttggctaaaacagctatatcaacacattttcaccgtttatttattcttctgaacaacttttgtaaaggcacttaggctcataactatcataatgtcttccttttactcaacatttttcctacccatacctatctcagggtcaaaaccaaacttcatcaaaaatcatgtttcaaagtttaatattcatcagaacaacctcctgagcatacttttctaaagaactcaagcctaattctagccctatcacaaaagggtcactattcaccccaagaacaaattctcaaatcaatcggtaaaacttgtgtttcttacctctaaatcgacagaaaaggctagagaacagcttttccaagcttgaacgtccttgaaccgccttcttttctcctcagaatcaaactttgtgaatttccctatagaactggatctctttgtttgatggttttcagagaaaagtgatgatggaatctagctcattgagtagttctttcaactttcatgttgggtgtgaaaggttttggtcaacggttgagtgtttaagaagcttctctagttcatcaatggcagaagcagagaaaaggaagaaaggaaagagagagaagggctaagggaaagagagagaaagagagaggctgttatattttccgacctgtccagacttcttcaggaatgtcttcttcaagtggtcttgatggtgacaaattaatcaagtcaactgctgttctgacggcttctccccaatatgctttcgacaatcgagcattggatagcatacttcggaccttttcttcaatagttcggttcatcatctcggcaagtccattcaactgcggagtctttggaggcgtattctcaaatcggatcccggcttgtttacaataagcatcaaagggaccgcaatactcaccaccattatcagatcgaaccactttcaacttcttgccagtctccctttccaccatcgcgtggaattctttgaaacattggagtacctggtctttggtcttcatcaaataaacccacactttgcgggaatgatcatcaacgaaagaaacaaaatacagagctccaccgagtgatctctcagtcatggagcatacatctgtatggacgaggtcaagaatcctcttgcgtagtctgggctgatccagtctcacaaacgaaacccggtgctgtcttccagctaggcagtgcgagcaactctccagcacttggccattcaacccggttaatagtactttcttactcaacatttggagtcctttctcactcatgtggccaagacgcttgtgccacaactccagggaatatccatctctgacagaattggtttctccaccaattgtctttccttgcatcacatacaaggaaccatctttctttccacgagccataaccaaatttcccttggtcagcttccatatactttctccgaagtagtttaccaacccggcatcatcaagcttgcctaccgagatcaaattcaaacgcatgtcaggtacatgcctcacatctttcaaaagaagtcggcacccgacatttgtggtcaggattacatcaccgacaccaacaatcttgctggtcacctgatttcccatcttcacgacaccataatctcccttcctgtaagcggagaagaatccctcatgtggggtgacgtggaacgaggcaccggagtcaacaatccaagtgcaatcatcatgggctatgttcaacatttcctcactgaggaggaatatctcggtattcgggttagtagccacagctgtagtgctcgtatcattcttcttctggggaacaatctgatctggcttcacacagccattttgttcatcatttgcaaggtccagcagtcctacctcttgtgtcctaccttcccacagtagaagcacttcaaatcatgttttggcctagtccggcctctggacgtatctcgtccacctcgactcttgccacgaccccgggagtcggtctttcctcgattctcagcaacgttagcctcaaacgtgctggatacacctcgttctcttctcctggcttcttcattcaggaggctgtctgtcacggcatccatcgtcagttttccttctggaatcgagttgctcaaagtcaccaccaaagtatcccagctttccggtagcgaactcagcaacagcaaagcctgcatctcgtcatcaatcttcatgttggctttggacagttgattcaaaatacctttgtaggtgttgaggtgctcaatcatactcatgccgtccttgtattctagcttcacaagccgacgaaccaggtgtgctttgttcctgggagtcttcttctgaatcatggattctaacttgttccacaattcgtacgcgttcgtgaactcggacacgtgctcaaagaggcttttgtcaatatatttcctgatcgtggccacgaccttccgactcaggatctcccactccttgtccgacttcccggtcggcttcacttcaaggataatgggatcatataaatccttgcagataagatgatcctccatcatcgacctccaatagttgaagttatctgcagtcaacttgaacatatctccgtcgtgagttatgccactggtctccatctcgtctccttcagaaccctcgaacctgggctctgataccactgttgggtaatcacggaccctcaaatatcaaatgcggaagcggaataaaatcaaatgaggagcgagagagacaatcaaatagttttacgtgggagaaaaccttcttcaacacgaagaggaaaacccacgggaccaattccagatcaaatattcactataacaataatgggttacaatgaatcaaatacaccaatgtggtggtacactcaatctctcaaacaatggtgatcactcaaactccctaaagtgtttcactcaaactctctctagagatctctcaaatatgcacagcacaaggcttgctcaaatactgcggaatctctcacgcagtcaaatatcaaatggcggagtatctcaacgccctctcaaatatgcaagcatgaaggcttgctcaaatgtgctctcaagactgtcacttgaggctctcaattttctgtgtgttttgccttcacccttgctcatctatttatagggtgaaatggactgggctttaagccatcaaatcaaataagattatatcttatcaattaaaagatatctattatatcttatcaaataaatatcttctcaaataaatatcttatcaaataaagataagattatcaatcaactaaaaacggaaattatccaacacagccattatgttgagcagatagttaagtttgtggctatgtgttggcgatttcagggtacagattcttcaccagtttgctgacatgactaaagactatagtacacggaaatgttcaatgaattcttcttactctttacagatgagtagaatcaaccgcatcattcttgtttactcatgttatggcatcttattcatgccaaaacatgtaatgctaccacttatatttgttaaattgcataagctctaatttttttctaaattacataggattttcttttctcctaattaactctcattgcaggtagatttggtgtttctcgatggtctttcttcttgttagttacttcatcctttgtcaaaagacatgcaccttaaagttattgtgtataattaatcacaaaataaaattttccattttgtttctttagtacctaccaaactctcttgtgagcttgtggccccatatattgtcttgtacacaacacaaggagtcaagttataattttatttcattatatttccacacctaacaaactcgtggtctcttttgtctcacattctacaaaggataggaataaagctaagtatgtaactcttcagtaaaagtgtaaacccttctttctttctctcacagtttaagtgcatctttcaatatcaggcgaaaaaatgtttgaggtaaaaatatttttgcaaagaaatcacgactcttgtttttacttttattcattggattatattgcaatacgctacagtaatttcaactaaaaataaaacatacagtaattgttttaacccacttggcatgtatgaatctctgtgcaggtgttttgttccattctaaatggatattttttcattatctctttgaatttgagtagacaggactgacttttggtccactactttaattttcgtggtgccataagcagaatcaaggggaactgtcatggcaggaggtcgccaaagctcagaatatctgttcatccaatacttgaaagattttattatcattattgttctattttcttacgaacagaaatgtccagttagaatgctggtaaatactatatagaattaagctttctctcaagatgtttatggaagagaaacacctttaaagaaataatcactatgcacgaagcgatactggtgagatgtgtgcagtgttaatggaaagaaaagagaaaagtgatatgtgcgtacttttttctctagaagcatcccttatttatactgaacttacctctaagttagtttaagattctttccgataatcatgccgagatctctaacagcttgacctcacgatcttcctaataatcacggccgacatctttaactatttaaccttacaatctttactgttattatccacaatatccacgatctcatctatagttgtaatcaaagatatcatctaacaattattaattactaatatttagcttttaacaatttatttggatgtaagagtaaaataaggagaaaataaataaaaaatgcaaataagatagctgtataaggtttaaattgataaaaatatagctgataaaataatatcagaattaatagatttattaggataaaatcatattagattaaacggtaatcttataattttttatatatttgatattattgtattatgtggagatcgaatttagattatcttttatatatttaatatttattatcaattaaagtacacaaattaaatatgataagtatatacttatttcagtataagatagaattaacgtatctacactccaggtattatcttattaatagccaatagacaaatgtatcaatattaaaattagtattaacacgaatttaaatttgatacactgtttttttattataaaaaaatgcgaatacctagatatacatctaagtgccaaaataatgcacattgccagacaagtactaaagtaggtcgagttgtctctcattccaataaatttcaaagtggacgataactcccaaccacgaaaattaaaggagttgggacaaaaacatagtctcaatggactataaggacacatctcacctcaccaatagcaccgtaaagggaaaaaaaagtgtttaaatgaccacaaatttcacttctttttgacaccaaatgaaaagctaaccacattagacaaggaattgctgattctgctatgctgtgattacacaacacattagacataccaagtcaatgatgctgtaaagaataaactcccaagactctactgaacatcctatctttttttgcaattgttcctggtgtcttaaaataggaagaaaaaaaaaaaacgtttactactttgaaggtgcgaatttatttaatacttttttaaactaattaaaaatatataatatgaaatattaatattttaattaatacattgaagatacttgttaatagtttttttcttttttaacatacctatttaaaaattaatactccttgttttcccctattatttaaggttttaatacacaaataataattatatttgtgcactcactttttattctccatccttttttatcacatttttcttcttcttattttttgtttcccttcactcatatacatcaaaatagagaataaatttattagaacccatacacaaatttaaaataaataatcttatcatatatactaaaattatctgtcaatttttttagtatatcttttactctctttttttcacttttacatttcatatacaattatttttgtctctcttttaataaggtatacttaaaaaaattgtaattaatattagagaaggtacagttttaaaaaggtgacatgtaaagttatctttaatcatattttttaattttaaaaaggtacagttttaaaattttaaaaaataataatcaaggactaattttaaaaaaataaatataattaatgagaaggtgacatgtaatttaattgattaaaaaaattaatagtatcaaaacacctcaaattattggggacaccgtatacactcccttaatattatctttaaatttttatgggacataaagaaaaatattttttgaagtgtgaaataaaataaaaatagagatggtaaatttttttagtagaaacaactaaccaaccaattaactacattggttttcaaaatttcaacatactcaatcaaccagccaatctgctaaaataaaggcggagtttaatcccccaagcccaggatttcaaatagattttttggaaattgaaaatagtgaggaagagataataacttcaacatcttactcagactaactgaattagatttcttagcttcacagaatttcaaatagtagttacaagtacatgaggcaagaatgattaataattaataatatgcggccttaaattgtttggttttttctgctgctgcagaaacgcttacaagttacaagggagctctaggaaaataacacaataatcttattaatctaggtgcatactatatattatatagagatatagaatagaaatctcatagttcattcagacttcagagagtggtttctaagttctaatcaaccctcctttggcaaacaactatttgtagctgttcttgacagattgaaccttagtagcctcttgtgcaccatcatatgacttgtcaacattctgattagtcaccccttccttggtttccttggccttttcctctgcaactctttggaactcttcagctgtggaaggtgccctctcttccatcaaacggttactacggtttccattgctcgcttgcccataattctgatactttcaataacaaaaaaataatacattactttctggtcactgtaacatgttgtcaacacataatagaatcattctttgagtgcatgtgtggattttattagagagttcaaatatgcttttacacttaaattaacaaattctacctttttcattttatatattgaaattcacaaatataaattggaattcacaaaaatacttttccaactttaatctaattaagcttagtttgtctaggttttaatccatttctcaagtctagatttccaccttcaagaactggattatgcaaaaaaatgaaaaccttccattaaatacatgaattctaccttctcaaacacatcaaaaagttaattaaaacttgtttccaaccaaaggcaaaatcaaactaaaaatgattaaaattccacgttttgttagtctaatttaattttctagtgggtgcattcgtacaaaaaataaaaaagtttccacagcaagtagataatgtaaattagtaactctagagcagagaagcaaattgaagtagaataacttggaacacgagtgaaagaaaaagaaaagaacagaacagagatttaaaaaggaaatgaaaataaaagggataccttaatggtgctgttgaagaatggcttactactgctaggctttaccatggaggatcttgaagtggcatggagaagagagtggaactgaccacctaccatggttcttccctctctctatcttcaggaaatgtttggctgtttgatagagactagttactagttagtataatttgggctctcatgtctgtttaaataaaaaccaaaaacaataaggacaagattactcctggcctcaaactcaatccagatatccatgtattgccctttgttaatgacgtaatgctaatccaatgaatctgtctagtctatcccacttattaatgacttataccaaaagaaaaatctccatcaatgactaaactgcattacacttatcacaaaattaattaaattataatttcaatttaatgattaacattaatatttaatttcaacctttattacttaagtatattgaaataaaagaaatactaacaacatatttttgaatatactcttttaaacatattctttatagttgactgaaatttattgataattacaaattttttaagtttcatttgttatttaatgactctttttctcttgattttgtaatttttaatatattctaattaaccaatgataaagtgtatgtgttagatttaaaacgaatgatttgctaacatttttcaataaataaaattgaaaatttactgactagattaaaaaatgtagttactaaagattttctataaaaaatatttatttttctctctaattatggataattattattattttttataagtattattagaaataaggataccatgaattttatttatcaaaatggaattttttttggtaagtttttccatgttgaattgaggttgaacaatcatttttaatttatcaacaaagcgtccgttcaagaaatgatcacatattttagttatatatgttgttttaatttcatcattagataatcaaattcaattttctaatatatcaagagaaataaattctttgtctataacttttttcctatttaaaaattcattgctaaatttgtaacatattaattgaatagtgtaaaataagatctcacatctaatatgtagtaagtgtaagctttcaaactcatctttttgttaagtaaaaacaagcacctttataagaatatttttatagtttatattgacaaaattactttcataattcaaaatacatgttcaattttttccccatcaatatatctgaataatattttttttaacaaaactaatttatttattttaatcaaaatttaatttaaaagttaaaattaatgtatatgtagtcagaattataatctttaacttattcttactttcctcattttaagaggctttcttcactttttcgttgggagatgtacttcacaatctttctttgtaattattgaaaaaaaatacagtaacttttcttatttatgtaacgaattgattttaaaaaatgaatttaatgaatagtggagcatttagtagaaagtaagttttaaatgaaaaattattgttaggtattatgagaaaggtagtactaacatgtttcaactgtgtcattaatgagtaattgattttgtgcattcattcactagttataatacattcatttattatttttaaggattttatttatttttaaaataaaccaaaataaaataaatgaatatattttttatatgttattgatgtgaaatattcatcaattttattgatgactaattttcgaaaaatatgtttaactacttttgttgtgatcttttcttttatctacattttttcattcacaatatctcaaaactttacttacttattttgagtttaatatcactcaacccaacaatatattagtggaaaattaaagatattaatctataataaatatttatttattataggttgtgtttacaaaataattactaaaactaactttgtaaatgtttcataaaattattattgtgtaattattattaatataatgtatatcgacattttataagtattgaataataataaaacaataaaataaaataattttttataagttatttttttttttggatttaaagataaatgtcggaagtgggatttgaacccacaccctctaacaaacttgagttgggcatcctgactttgataataaaaggttaaaactaattaaggagttatacttttttaactaatatatatatatatatatatatttacataattaaaattagttaatttaaataattaaatatttataggaacataaaaattttaagaattatttttgtaacttccataaatgatatctaattacaaatttttaaaaaatatttacaaaaaatattaattataatttaactaattataataatttatgttcaatataaaaactatgggaatatagaaataatatgtgtgtatatatatataatggaattttttatattcaaagactaattataaaagtaaaaaaaatgttaatatcaaaacaaaaaatccaatcaattcacgcctttattaatccttttagagcatacaaaaatgattttttataacaccctaacataataattaagtttattttttgaatgaaatgttaattaagtaaaaactactgtactttttaataaccatatcaatacgacattagtaattaatactagttttttccaatatcaattcgaagcacagtattattggactagaaagtaggtaaccctgcttttgcgcaggaacatcgtcaacactcaacataggatagatagtttgttcgttgcgttgccatgtcggcgtcggagattcttcgggaactggatttgctgaaggacgaaaagaccaaaattgagcacaaaatctctgcgcttgaagctcaactcaaagagattaatctccaaaacgacgccgcaccaccctatgcttcttcttcttcattgtaccccaccaatggattgacccaggacatgattcacagatacagtcgccaccttgtgctcccttcctttggtgttcaaggtcttcttctcttcaacattttctatattcatttaattatcattcatgctacataaacctaattaagtttaaattaagaatgaaggaagattcatattcgttgcacgtgtgtgtttgagtattaactgtagttagttccatgttgcaactgctttatagtaacaaccttaacaattgcaattttgccatgtattgttttcactgcgaaaatagacattatagacaaatagcccttatctgcatgtttatcttgtttttttttttttttttttgtcttaaattttcccaccttcttgtgtttgtggagtgcagggcaggcaaatctattgaagtcgtcaatcttagttgtgggagctggaggtttgggtgctcctgcattgttatactttgcagcttctggtgttggtaatatatgacacttctaagctttgtttggataaatttttcataaacacttataagtgaaggaaataagaaagaaaaatgaagtcaccttcttgcacaagttaaaatcatcttatacacttaagcttttggagaagataagtgccaagttgattttaacttatgggggaaacttaatttattttactttcttattttcttcttgtcccaaacataacctctgtctatatgcttcttgaaacttacattttaaaaactatactcagggcgcttgggtgttattgaccatgacgtagttgagctgaataatatgcataggcaggtattgtattatctgttttaccttcccgccctcttttggcatagctggtgcaacacgtacattgtgaattgttgtgtttgtgtctggcatcagcctttgggcgtttgcacttttgcgagtacaaggtgttatatgtgtcttgcttcagtgtttgtgttcgtttactatttttttaattaacttcactatttttattaatttggacaagttggtgctttatttcaggttatccacacggaagcatatgttggtaagccgaaagtgaaatctgctgctgctgcttgtcgctcgtaggttactttttcaccaaccattcatcacatcaatttttgttgacaaactgcaaataaaatcccatgagaaattttctttttcaaatgtttgttattgtaatatttgtatcatcattgttcttggaactaagatattttgaatattaggatcaactccactattcaagttgtggaacatgaagaagctttgcggacttccaacgctttggaaattctcagcaagtataatttctataataagattgatttttctttttgcttgaggcctctttcttctatacttacattttacatttcattttttatattaccactgactatttttttttttttttgtaattatgtgaatttggtagatatgatataatagtagatgcaacagataatgctcctacccgatacttgatcagtgattgctgtgtggttctaggaaaggtaaatctgaatgttttgatgtatgaacagattgtgaccatttgaattgatgtcacatgggccttttcacttgttgctttaattttttggttcctccatgaatacactttctaagtcagcattatttttaatgttttggttcatcaatgcaaaagatatctacattaattcaacaaaaaggaagttatgcatgctcctatgtgcatgataccgataaaatatttcagtgtgtatgtgccatatgagttgttatctccaaaatctttgtgcaattgctcccagtagacatcaattttttataaatttgaaaagttacaattatatgaatttcttatatttcattccgttaaacaatttcgtttttggttcttattttttatacttatgtacatagtatgatttatgggaaaacttaagttacttttgcaattttttatattaactgttttcctgtgatgcagcctcttgtatcaggtgctgcactgggattggaagggcaggtatatgtctaattttttttcccctagcatttaagttgaataatgcttcatagtgcgacaagtactcctgtgtgcttgattatatcacaatttgaggattaaatattgaaacttttactgcagcttactgtctacaattacaatggtggtccttgctatcgatgcctcttttcaactccaccacctagaacagcatgccaaagttgtgctgagggtggagttctaggagtaggtaaaattactactgtctttgtgaactgtatcacttttacttctcattgctagtctgcgagacattttcattagcatgaacaatgtgaaccataagacaaattcttctgctctcctgttttcattgtgaagttcagtcatggacttttagtaatgtgtactataactattagtgacaacaaaaaatgattctgattgtttgattccttttgccaaaactgtctctacaaacggggaagtatctatgttttaagcaatcaagttttactgaaaaggaggtttttgcaaacaataagaaattcttattgtttaccggagagtgtactctttagtaagacttattggctaaaaattcaatttgtttggaatgttttaagttgtttcataattcgtttagctaaactgtgattattatcatccgtgtcagttattatgaatatttattgttcaacttgcattacttctcactagtacctttgtattttttgttctgctattgctatttttctgcttttctgacatttgctctgatcattttcagttcctggtataattggctgtctccaagctcttgaggctattaaaattgcagcttctgttggtgagccactctcaggaaggatgcttctcttggatgcattgtctggacggattcgtattgtatgttaagaactccaatgtctattaggattttacaagtggggcatcaaataattgtttgaatgtttaggatttcttataaattaggattttatttcgataaattacctggatgcaaagttagggttttgtatcctagtggtattggaactattagggtaaaggttttcctacttaaggatactctttagaggaattgattgacattactattgagtgattctcatattcacaccaatttttctgtcactaataataactgtcatgcagaccaatcattttctttataattctaataacaaattgcttttcaaactggctatcccaaattaaacttagacttgtaatatatacagttccaaatcatatttgtaattatgatgtctcaaagtaaaaaaattatattatggtttttgaggatgataccatagcaagatcttatttatcagttactgattatactttttttattacacaggtcaaaattagaggaaggtctatgcagtgtgaagcttgtggagaaaatgcaacatttacccaacagcaattccgagaatttgattatgagaagttcactcagactcccttgcgtgtggtatgatttcttttttttcttgcctttcacctcctttgtatttagatgaaattgtttgaaggtttagttgggtatatttttcatttgcactttgtattggatgagattgctggagataaaattcctcccaaaagactacaaaattgtctcccagtatatattattttgagattttccatgtcattaatgcattccattccatttatatgcagcctcctttgaagttaaatctacttcccagtgaatcaagaatcagcagcaaggagtacagtgaagtaattattaagaaggaaccacatgtgctggttgatgttagaccaactcaccatttcaagattgtatctctaccaaagtctatgaacattccactctcaacattagaggctaggctgcctgaagtatcatcagctttgaagaaagaggaagaggaaagtggtgcagtttctggatcaagtgcacaattgtatgtagtatgcagaaggggaaatgattctcaaagggctgttcagtatcttcacaaaatgggtttcacttctgccaaggatattgttggtggcttagagtcttgggcccacaacgtggaccctaggttccctacatattagctgacacgtatagctatgctaaatattactttcattaagttatactgcttgcttgaaattatttctccctatattttattagtgacgttgctttcatttttccatgtctatttataacattcacgtgacttttttttatagtcttaattgattttattcttgcttttgaattgttatagaaaaattgtagcctattcatttttacttttttcttcgcattgggtagagtttaaaaaaccacaggttattcacgttgttgctacagttgccaataatagttactttccattcctttcatcaaatgatgtttgctgagacaataatatcacatggaaaatactaaatgttacgaaaatttcattgtacgaatccacacaaatatacgtggctacaaattataatacctatatcggagttaaattaactgattcgtgaatttcatgtttttgtttttcgtacggtatagcactgctctcaaagtattaaatatccatcaatttagttcctattttattaacattcaaagactaattttaaagatattcgatttgtaatttcatgaaattattacgataataacaactcgcgccttaacatggatttccataaagcctgaccacgcacaaacacatagtcatatagaacaaaataccttgcatcacgtatcccaatccctactttgatattaacatatgcttaaggcaaccaagtcaaaaagcagcataagaatcataagtaaaacaaacaattctgcaggatttggtcgttctcataaaaggatcatttaaacgaagaagactactttgttagtttgcagaaatggaagcagagttcaaacacttagtctgaaggaagttaagccttgcagagacatgattgtgcatttgccttctagagtttcaacttttactcattttatatcagtagaattagatggtgtaagcaaagttgaatccagaatttgatgatatgcagattattccgtgggacacagaagcatggtcctgtttcttgttatggataacaaattaccaaggttatggatgttataaacttccacgttataataatttagattgtttatattataacttagtgactgtagcttgcactgaggtggaaaaaaacttgcatttcaaggaaattttactcatgtaaaaagaaaattttatttctccctctcactgtatttgtgacgcctaactacgcttggaaacacagtagatacatgggaaaccacgtccatttactaaaagacgcagaagcaatacctaccagctctgatctaactgtgaaattacgtcaacatgataccaaacatgctaaaaggcaaggaaaggagacaaagaaaacaactgaatttttttgacattagatcatcccattcactttgaaaagtgaatgcatccttaccaaccaagaagcaatatctttaagagagccatcctaatatatagaccattctttgcctgcctaaagtaagcagctcttggatctctatcaacttccactgtgatctgcatgaaattaagggaccaatttagtttatttaatcttaatgcttgcattcgtatcgggataacatatatcacatgacatggcaatatgtgcttacctcgtcaagtcttggaagagggtgcataaccacagcatgtttttgcatcacatttagaacatcttgatttacaatatacttgcctcttgcctcctcataaagttcaattttttctccaaatctttctttctgaatgcgagtttgataaaccacatcgcacttagaagcaacttccatcaaatcagcactttcttcccactccactccctttgatgtcagatagtcttttatgtcatcctatgaaaaaaaataaaaaattccataactcattttgtcatgtaattcccaacatcttatccttctcatgaaaccataattagtatttgcaacagttaccttcattttaaccacgtttggagagacaaaataaattttcacatcctgatacttggctagtaagtatgcaagtgagcgaactgttctcccattagcaaggtctcccacaagcccaactctaattccgtccagttttcctatctctctttcaatggtataaacatctagcagtgcctgagcagtttgaaaaagaaagagttttgaaacacaaaaataatatcatccaattaccacccaaactattataaatatagcaaaataaacaaacaataaataaaaagtcacaaaaattcccctttgtctgtattttctacaagaaaaacactaaagaagaatcaaacatggaatcatcttgtcaagtgtaaataaactagtaaaatatataaggtatgtacctaaagaataaagtataatcaaagaaaccttcagattgaaaagtccataatatattgttataattggctaggaaactggtgtgtactcaaaggaagctaccatttcaatccttgatagcaagcacctcactagaaaaatggaactccatttagatttatacttcaattggtttttggcacatttttggttaattgaaaataaatttcttttccccaagaaagagaaagatacaatttcttgagtcgaagtcttgaaggtatgtcccataaaagaattaattttatattcataggtcattgtaaaccccttctacccaatcaacttctcctaagaaattataaggagaaattgtggccctttcagtttcaaataccatgagacagcatcagcataataagggggtttgtttttaaaatttgattgggagtaatgagtcatggaaacaaatttgttaagtggattttccctgtgtttggaaatacgtttggcagggaacaaatcaggtcaaatcaacaaatgatgcaaaagttacacagccagtagcttctattcagatctcaaaaaccatgtccacgaggaccatgacacgttaccagacacacatagttatgcttccacaaaattgctcagcagcaaaagcttatctatcatagttcaatgctaattcatggttttaacaacaaggtggcagatgctacaaatgaaaatgaaatagtgcaatctctgcagtcaaaaagtagctaagggcaatagactcaagattactttgaaaaataaatcatcctatgataatatctacttgacattctatgtgaagcatcagaattataatctgtacctattgtggcaaattcctcatacctgggtgggatgctgtccagggccatcccctgcattgattacaggaacgctagcagttgttgctgctcttttggcagcaccactttcaaagtgcctcatcacaattatatcagtgtaaccttcaaccgttcttatagtatctgcaagaagtaaagttccatgaaacaccaattttagatagaataacaatgaaagaacccactaagtactaacaaaactttgcattgttaattgaaaggacataccttcaagcgtctctcctttagcagcagacgaaaactcccttgcattctcagttgtgagaacatccccacctaatcttttcatggcagactcaaatgaaagcctagttctagtggatggctcataaaacaaagtagccatgaggtaaccctttagcatttggctcctagatgacttgctttcaatgctctccatgctccttgcaacttcaaatatggcattgagagtctctctgtcaaattgctgagcctcaatcacatcatgaaggtgaaatttttgccccacagagaaggagggtgcactttcaacttgaagggcccccgccctccacagaatctcatcacctttatgtgaaagtttaacattttcaaagactcctgaatgcccaaatggtgtttttgactttaaatgatcccatggctgattgagcaaacagcatggagaggattttgcagccaccttgggatgagacacacccacatgcatagagcaggagaatagcaaagcagcagcactcattgtgttctattggagtacaagacaaagtgcttatatgttattacagaagcacacaaataaccattaattgcatactcaagtttcaaatccttcaactctcaatataggaagcaaaagggcatgcatgtaacttgaaaagatattggaaaaaaaaaacattaattaaacttgttttgagtggaatcacttttttctatgccaagaaacaagaggaatcacttttttctatgccaagaaacaagaagaatcacttgactataaatgtatgtgctttaaaaacatcgcttcagaatagacggcagaaaaattcggaccaaaaaactattgaagatgataacataggaaaaaaaaaagaggaagtatgatgaatccaacacagattttctagaaagaaataacgaaaagtttagagaagaaatagaataccgtgaggttatttgtggagagtgagtagttttgttaattttgaaggccgacaacggctacaaaacagcgttgcgaccgtcgtgcaagaaggaacaatgtgtgtaggctataagaggagacgacctggtttaaaagtaaacctttgttagggattgccactctcactcccaattttactatttgtaccctacgtgctttaaaaatgacattattccaaaaatactctttttaatgaaaaacatgattctattaacaaattagacaatgagatcatgtctccattatgtaagaggaagtgcaacgaaaaaaatattatcaacgaaatcatattttcattgtataattcttttgcactcttgtaatcaacaaaattatgtttatattctatatttttctttacaaatttttgttaattaattataaatataagttactttttttaagtaatacaattaattgtaatacaaactattattttttaattaagattaaattaattaagagacaacttacagtttttaatagtagtcaatgtcatttttaatagtaattaaattaaatatgatattaatttatatcataattaatttgattataattaaaaaggataatttatatcatcattaattcaaattttaataaaaaaggtaattcatatcacaattaattaaaaaaggtgatatgtgtaacgataatttgtatcataattaattcaaccgttattctttttttggattttctttttaaaaaagattagagtgggagaaaggaaaagatgataacaatcatcatttaattacaaattttcatatataacaaatttgttgaattttataataaatatgtcaacaaacttttaattgatttagtcaaagattatttttaattcatcaatagtgtaatttttttatcttgtacatgtttattaaacttcaaataaatccttaaaatttataataaagaataaataatacatccatcaagagtataaaaatgttttaaattgtcctttaatcgcatgttgttatgataagtttattactagtaaatatcttaaaattatattatagatgattttaaatttggttgatcatataggagctaaacctattatactcaaattaaaaatgtcccgtggttttgaagacttgtttgtaatttttatattaaaatactataacaaaatttgcttaaagaattgttaaccataatgcagttctttaaaaaaaaaaaaaaaccataatgtagttgttcacttgttcaaacacttttcctgcgtatgtacgtgaaaaaaaagcaaactaattttattgttttggctattttaaaagaattaaaaacatgtcatttttgtttgtacaataaagttcataaagcttgcaaaatgttttgttagcgatatatgctattgaacacaacttaaaaaaatgaatgccttattaagatttatctcaaataatgaaagattataatatagtgattcgtccgatgtaacatccttttgtatgcatgacattgacgaaataaaaatctctatacctatgttgaatatgaaaacgatcaaaactacaccaatttgcaaaagcaattaacgagtcttatgtattattgttgcaatgctcattagtgtttgaatgtgaactccccatgacagatgttatagctgccacaagagggcagtgaaattggggtctgctgtgatagcagcagtggctgcatttactatgttagcaaatgatgaagttgtgtccattccctgagactcatgcaagccagcaagccagaaagcttagtttgatcacacagtgccagtccaaatatttttggaaatgacataaacttatgagccaaaagtgggaataagaggccatgttggccctgtggtaattcactttgtagctgtaaggaattggttgcattatgagtgagatccaatgtgatggtgggaaatggggctgaggtcaaagagttgccatgttctgagagcatggaagtgaagcactttctaatatgcttggattgattaggccatctgagcttggcattggtccagaaagaagcattgaggcagctgcatatgttgtggatgccattgcctgggctgtggatggttatgctgcccttcatatgttgtgatcagcacacttctgtctacagcacacctctgtacctatgaacaaacataaatccactatttggtaaaccttgatttctctgtataatactcatggagtttaacaaattaacacacacacacacacacacacatatatatatattataaagtttttgtactatcaattaatcaaaaataatttttggtatgatatttaagatatacttattataaaagtctaacaaacttattatacataatattttgtgattgagtgattgtataaaaggtgttgaattatatgcatatattatttattcatgttaatgttagagacaaaatgtatcaattccttcccaatggctttaatttgtagccattagctaactggcaaagtttcattacccctcaagatttcttagaaagcaccagctgatacaggctttttgatccctataacattcacactctaagctgtatatcattttccatgcccttaccaggcacttttgggtagcgtatgtccccaaaaaaggagagggatcgattggtaagtacaatagaaattcttgtataaacctaatatacttgagttgggtgtgcattactgataattaaagtacagtattattaaataaatcttttgttcactaatgtattgattataattcaattctttgttaatttagtgcactcaactcaagctaggtaaagtgtgctaaattatattaaaattttgcaaattaagttttaatttgtctttcccccaccagaaatgtcttgctagtttcctaataccgtaagagaatttcctccttgctttaattagctagtctcagcagaaagaacaatttaacgcaaattaaagaaaaaaaatttcctagcaagagtgcatacttgtttccttactgggcaaccagtactcattgtgcaacgataataggctcttggaaaaggatttcctttcgccctcttcttcctatactttcgccattggcatccatctgcaatctgtaataaaggattcatccaaaagaaagttaacacgtaaattttccatgatgtattttcaagaaacaagaaattaacgtgtgcaaacttcacattagtaaattacatcccctttccttagaaattagaagtcatcgattagctagctaactaggctgaatttgttaatgggtaaatcacatgatgttactatatattggagatgatagagttgcatgtcaattttactttatttatataatttactaaccattgaagaaaatcttgctcgaactgacacacgagctttcttgattgacatgatttttgaagctggatccaatctaggaactttgttactgatcaattcttggtcagcgtgcctcccttccatgcattctagctttaatttgcactttcccttccagcagaatccaacttatctgtctccaaaacagcaatatctttgccatgtcctaactcaaccatgcttttgcttcctctcagtttcccctctaaagattgctgggtatttggctcatcctcgtcagcaacatccatgtcttagaatgactttggaaccatatcttccattttccctatcactccgtaattctacacaaaaccaaataaaaaacaagtgcatacatgttttcagcattgaatatatgatcaaatgccagatctattttttggaactcaataaatttattaagatggatctatcaagtaaactcaaatataccactacttatttattaagttatttgatattcaatgttataaaaacaaataaataaattaccccatgactatgctgcttctgcgttagcttgacaatttgcatgcgtagggcattgcagttattgttcacctcatcaaccaacactcttaaaacttgattttcagcattcatttggtccaattcagttagcaaagctacaaactatacccataggaataaattaatattaattactatatattcatcttaaacgtgctacctttttgataaatataaatcaaacatatataacatatatacctagacacaacaaccaattagggtacctcgtagctcttatcgtccatagtttccaatgccgcatcttctttcgttgatctattgacaccagtatcattcttcgtaagaagatctgagctggtctataaattaacacaacaagaacataattaggtgcccatatatataattaaggtaaaattacaattattaaatctaaggaaatatttaaatgtgagtttggctacatatatagtacatacatcaacatgaaggtcctccacactttgatgatcatcatcaatatcatcatcttcactctcctttctcttctgagcaaaatcaagctcatccatgacaagtggtgtccttctaaacgacatgactggatcagaagaattactaccgttcacaatgggatcattccaagtgggttccatgttgattatatgtatatgtatatgtatatatatatatacactccctattatgttacgtagtgtgcttggggagcaagaaagtttttgcatgagtatcaaaaaggactcacgtagttgtgtctacaaattatttaaagggtgaaggaaaggagtgagaaggggtagatgtcagagatagatgcaagggagtcggcaacaaaaaatgggttttgactaaaaccaaatattatgtgtgagaatatataccaagatgcagtagtgatttcagaactgaggtaagatgcccacgtgagtgatttctaaaggagaaaccatatgaatggcaatgagagagactcttgacttagactaattactatttactagggcttgaaatgttccactatatgtaatttaccatttaaagattaacaattatatatatataaaaatgaattgaataatttattttattttattttttaaaataatatttataacaatgaaatatatatttgtgtgtagaaattttttactcatgtattatgaatttaaatcacatgaaagaaaaataaacaaccacaccataaaattagagatattcatggattgaattaaaataattttgaagagaaaaataatttagtttaatagcttcagttttcttaatttttcatttaattggtttaatttaaatcttaaatccagtttaatacagtctagagtgctttggattgaattttttttcagttgtagtcttactttacttttctataaataaactattaaataaatgataaaaaatattaaacataataaaaaatgatttttcaaaaaataacttaaaatgtcgttcaactataagtcattatatatcttagttaaatatattttttcataaataagtgtaaattatatgataattttataaatatataaaagtttagtttggattgcatcaacattgaaaaccaaaactgaaatctggtttaattcaataaaaaaattagttttttcgtttttaatttgttcaatttttagtttattcgatttattagttttgctttttcagttttatttagattggaccgatctatctctgagcactcttggataaaataataaaagtgtatatgtataattattaataacaaaaataaataaataaataaaatcttctataaaaaaatgggaaaaataatgggtcaatccattgaaattcaacattattttttattttacatgttttaagtttcaactctctagaggacactttaactcaaagatcctcaactaagtgtaatgtttatcgccttgtcaagacaattgatattttcattacagtaactgagtaaggaccatccatattccataacaaaagatgtccatcgttgacttttccaaccatatattgttatctttattgggtagagttgttttattttataaaaaaaatctaacagctgttacaaaacgttaatagtgatttagaaagaaaaaaaattattattttgaaacaatacattaaagtcaaccatgtaaaaaaatgcaaaccaaggagttaaatattattaaacaagggaatagataattttggttgccagttaagtggcattttttataacacgccttttctttttatgcttaacgttaagggttcttttaattaatagtacgcttttaacttatcaaaagtatttgtacaaactacaggacattaagccagaattcaaaaaacataatttgtgtataaaataagaagtgtttcgtttaccataaaatttctaaataaaataaaaaactcttattccattatgttcctttgcttttcatatccttcaaccaattcaaacagccaataaagcaaatgccgatgagagcatacatcaccttccaaaccagattataaacaagtaattgtttaaattgcaaattggtacgacagttgatagattcgctacactattgaatctgtcatatataagcatacatcattactacacgttgttctcctaaataaatactatatatctctgttaacactaattactaatcctaaatgtacataattatattatgtcaacatattaaatttacattatgcctacttgtataataggagcacacaatactaaatgcactctactgaccatcctgcatatataaccaatgctccaattgactaggtggggtaaccctcttcctaattaacatttcaacagtgggacatgttctcttccttcctcccctgggccttgacctgaactcttcatcagcttcttcaaaatccccctgaagcaaggaaaattatgagcaagtcaatgaaaaggcatgactatatgacaatatcacttataagaaaaccttttgcacaaagggaatagaaggggaaaagaacttacaagggtaaaaacatgtttagaagttttttcgtgattatctcgtacatgtttgtaagcaaatctcatgccacaatcaggaaaaccacaaacaaaaggcctttcattaaagtgcacagccttcttatgcttatcaagattagatttctgttgacataaaaccatgaacaaattaaaagaaagttcaacttgtaaccaaacagagaactcaattatagtatactctgattagatttaagaatgaggagtcttactcttgagaatgtgcagctgcaacccttaaactcacattgaaaggtctctgatgaactgccttcgacttcatgtgatcgaaggtgacgcttaatattcttcttcagttgcttagtcccacaaatgtcacaggtcatatattgatgggaggatttcacatgggcttgaaggcactggacattagcgaaatgtttcatgcaactaggctctaagcacaccacatctactgactccaacttaactgcagaataaaggctttcttcaaaattgcacccaacatctttcactaatctaaataaacaagaaccttacaaacatcccatggaaatttaactaactcaaagaattacaaaaggaacaaaacctaccatgagaatcttcatgtttttgtagctgtgatgcatatctaaaaacctttccacacccaatctcgggacatgtatgctgtttatgacttttgtcactagtagaggtagaactgttgtcatgaatctcctcaatgtgtcttttcatattgctttgcaaagagaactcactgttgcaattctcaacagggcacttaaaagtctttccttcatgctgaagaaggtgccgaatcaggtggtccttccttctgtaacttgcctgacaatcatcgacaggacacacaaatggcctctgtaaccattggaaaatactgttaaatccagaaacttacacacataaaggtatcatgatgctctgacaagaacaaaacacaaataaacaaactgccaacctcaatttcgaacagagcggtgaccgaggcatccttgatggagcttcacaggaggtctccctacctgatactaatccatcaagttcatatacgctgcctcgtgcattttggagttctttttctgggatccaatgcttcacactattaatccataattttccaatgattttagaatcttatagattactatcctgcaaaatatgtattttcagtctatatacaacaagtaacacaatcaattcacaacaccaagcctgtcttccacaaataaaatgtttctcaaggaacacgacggtctataaaacatacttagtttaagagtttcacttaactgaatctatgttttttcttaaataataacaatatttaattgaagagtccaaatacctcatttgaatgacttagcatgtgctgcaacaaatgggcttgttttttgaaagtggcaccacattcctcgcaagtgttggatttcgaagcctttccttcgggacctctttcagctcttgctttttcatcctcttcctaaaaacacatcaaaagtaaacaacaaaaccacacataaccctacataatgatctaattcaagcagggttgcttataaacggtttgattttgcagaattagaaagaagggtaccttgtggtgcgaattgatgtgggaggtgataagggtttttttggacctgcagatgccgcagtactcgcagaaatagcgtctaatatctttgaatttgggcctttctttagtttccacggattcacacatttttatggtgaagagataaagagaactattggagattgcaaatattcgatgcgctgatgagggttttccgggagagtgaggactgcgatgtgcgcggcggcgttgtgaagctacaaatgtgagtgagagtaaaagtaaagctagggttctggacaacggaggatttatatagtgttcccatacgatgtcgtttgcatagtttaatgcccgccaaataaccaactatttattaagttataatatatgataatactttgagtaaaataagaagataagtattttaaaagtgagtctaggtcttaaattttaaactgtccaaaatttccagaattttattttattttttcttccaaaagtcctaataatttactcacgagattataatattttgtttgaaatatatcaatttttttgccacatgaaatatgtccgacattacataattccttgatgttgtatttgattgataaaataaaaatagaaaagacaaaacagaagaaagagatcaaccaagtactggtatatatttgttttattttagtgatttgaacataaataggaatgctaaaaacatatttactaaaaatattatagttcattatatggttttaatattccaatttaactaatttataatcaatatattttcctgtagttatattacttgtttcaatacttacttttaccataccatcttaatcataaaatttatacgttatcgtaatttgcaaaagaaaaaaaaatcaaattttgcacgtttattattaatttttacctaaccgtttcttttaattttagtagactactctaaatattattattttattattacgaaaaattcaggatgtttccgttgtagcaatggactataatattaccaaagaagttaaagcaatacaattattgtcagccccatatagcttttacaagttagccatcaacatggctcgaattttggctctaagctcatcagaaacatcagttatttcaggtgattgagatggtgcccttggattagataatccctcagaagcctccctactagcacgtccaacttcaccacttactactgacttttccgatttcataattatctccccctcctccagctctctttctctttcagcatgagatctgctcttatgccctacacttctgcttctgcttcgatgcctatgctcaccatcagatgaactacaatcttcattagaatggcaagaatgtctatgctcatggtctgacaagttctcatccctatgtcgttgtttggaagagtggtgcttttcatcagaggagctatcatatttatgacgacgatgccttgggcgatgatgttcatcatcagaagaggagctatcgtgcttggtccccctgtaagaatacttgtctttggaggaggaatgtcttctcttgtgcttatgcctgtcccgattgtggtgtgaagtacgatgtgagcgatgttttttcctggatcgtttatgatcccttctatcttctttgttttcttcttcttcctcctcttcatgtctactagatcttgagcggtactttctttttgaccggcgttcattatcatcaacagtaagtttctccttagatttctgacttttatctgaattattatcaatagaaagattctcctcagacttttgacttttatctgaattatcaacatcaaatggaacagaacttccttccctttctttacccacaagattcccagtctcagcatctgaacctgaaactccagagcctggtggctcaactgataaagctcgtggcagttcacttgctccaacaccacttttaagcatggctgcaaacatctttgctcgtttcagtctctctgccttaagcttttgctctttagtcatgtgaacttcagaggagtccgcctcacctgctgctgccatagctactttttctgcaatagccttggcaacaggggcagaagcactagcctttgcctttacattcaggttttgactttcaacaaaaccttgtggttgaaatgaatacagactaccagtcccagagctggacaaatacccaccatcacttccaaggccttgaccactaccacttgatgtcttggtaagaacttccaaatggggagttttaatacccctagtggcagcctgaagaatagctgcagttgctgctgcatccatactaattgtgttttgagcttggtcttttggaattggaccttgatcatccttcttagacttgccaataatcatcttgaacttttcttttctgtccatgtcatatggtagatcagaagccatagatccatgtgaaagattgtcactaccttcatgtacagcagctttattgtcccctgtacgacctgctggattgtgcttctggtggcccttgcctagtaacttagactacaaacaattaggaagatcagtaagtagcagctcaaagtcaaaattaacactaccttaatcagtcccaaataattcatagaatacacaaggtgcaaaaaatccctccagaacccaaataaaataattaccaaaatttgaattccatggagaaggaaaatctttgaaaggcgaagttgaataaaaataaccatgactgcttcaaaaattcataatttatcacaactacatggcaaggcattatagctatataaagcatacatgccacatgcatacaaatttgcataacagacagaaatacaaacatgaccaatgattaattagaataaccaacattagggtactgcagataagtttacaggtgataatatcagtcaattaaattatgtttttgctttagaggggagggaagagtagggtagaagggaacaatttgaatcacattaattgaaaattaaaaataagctaaattttaatagttctgagaaacacacctcttcagcagtttgaagaactttcagatagtaagtatgatatcgattagatggcagaagaaatgggaaccttccatgaggtcgatcctgttctgccagaacagcctcaaattgttttccattttttaagatgaactcaactatcttctctatagctctctttaaatcagatggaggttcaacaactgggagttcaatcttagcagtactcgttacagaagtttgcgacttgttctgtgcattagatactgaatccaagccatcacctttagctctagctgtggttacagtcttaacagtaccaatagaatgattccgctttatgacaggaactttttctttcaaagagggtattggatttttagaaatgcttccatccttcttggccacatctgaataagattctgcctgatctattcctggagaagtataattactagcagcatcaacagctccctcacattcttttttctcaacatcacaagtattctcagttgtaccatcctcgtcctctccggatccatagacagatccaagcaacgacaatgcaccacctgtttgatcaagcccctgagtcctattcatgtcctcagttgagcttccatcatctttgtcaactttcagaagttcttggtgatcaacgagaaacctaaaatatgcatgaagatgatgatcgggcatcaggaatccaaaagttggattgtctccttgtttcaccctcagaatgatttctgactggcttccatgtttgctgacaaatgttgcagtccttgaaataatctgatgtactttctcatttggaggctggaaaagaaaaacaaacaaacaaaaaaatgtttcgtcatcaataaatgtgaattccaaaattagtacaagtataaacttaaaaagggtctagccaagcagaatatttagacacttgtatcctactaaacaaacacaagacaacctcacaaatactttgataatgataaagatcaagaaacagaactttatgaagacatgtatcattccatttgctctcaagaggtaaggaatcaacaaatttctatcatcctaatcccacctgcacggccccttctcatgacatcaaaaggaaccaaggtgcctgtgaatggctaccttgagtcacaagaactccgtttatgctccgagcatctgaaacttagacattgtaagccttagaataacatatgtaccctagacaattatcacctaatcacattggttaaacaatgaaaggtcaattaaattagtaacatcggaaaaccacacaatttaaagtatatattaagacagaggttactcaccaggttattgagtaggctttctggtactgggaatttaggatgaaaactagactcagtatcattgtcctttgtctccatggacacattagaatttccatatgaaaaggcgacagcatgaaagccagttgaactcactggatctgaaccataatctaaacacaaagaggtgatattcttcatcagaatcaaatataatataattctcaataacaacaaaaccatccagcaaaaacagtagttgcaacacaacgccaaacttaaattgaagccaggtgaaaacatccttacttgtattcagacacgggaaccgtagcaaattaaattccaacctgcaaatgtggagcttgttgttgccggaaaaaaaaaacactctgacatagactcaagtggaagttggattgttccaacatgcacggaaaaaacatgtgttttgctagccattagccaacaaagaacccacgatcaactagttgccccaactaaatgtgatgtctaaccaaatatatcaatgtgtcaaaatgatgagaacaaattgaacaaacttgatagacaaaccttagagaattacccgtgactgattattaatagcccttgctctatacacacatcacaatatgtcacacacaactcaaaatatcaaagccctcattgttacaaaaataaagattacgaaggcaagcttttttgttaaaccagaatatgttctcaaaacctttcatcatgcaaggaaacattctagctaaagcccacaaagaagcaacaaaagctttatcttaaaccgctgagctcaatcaaaacccatagtttcactcccaaagtttaaggacttcctcgaacctaattaaacagaacaacttccatttgattgacttttctcaccgtggcctatataaaattaggatgaaccttgaacactaacaaaacttcccaacttctctccagggaagaacataaaacctcatcaaaacaaaatcactaaccaaagctcccatagcttcttgtggtgaaaacataaaacacaacaaacaacagagttccaaataaaacagaaacatatttggggaaaatcaaccctaagaaagggaaggaactagaaagtaaaaagtatagaggaattgtgtatgaggttaccttgtggctgttcgtcgtcgggagaagaggaagggagatcgagatagcgctggtgatcgagatcgggttcgggcggaggagggcggcgcttgaggcgcggggggaggggagcggagagaaggtggcggacatcgtagcggtcgatggaaagagagttccattcaaccagagcttccgctgagttcacgaacgccgccatgccgtcgtcgtcgaacagcatcgcgtgccgccctgccacctccagatccatcgcttctgcaacttggttgattatcaaaacgcacaatctctctctctctctctaaaatatgaaaacgatgatgattatttgtttgtcgctatgggatttgaaaattatgaatgaacgaattttgggtaatgacccgtcggaatgtgccctaccggctacatctatgcacagggcccgggttttagttggagctttgggcctttggcccattcgtaaatgagttgattgtcggctttctgaaataattaataattaataacaatgtgtatattctgcttcaaaaatacaatgtgtataaaacttttacactctcatcagtatatttaagttcaattctaataattagtttagtctctcttaatgtagctattctgactatgaaactgatgtagttagttttaatcaaatatcagaattcgagaattctacagtcagatagagttttcagaggtcaactataaccaaaactacttaagtagttccactgccagcaagatgttgagttttgtccacactactaccatgccaatttatttagcgcgagacaagtttggtaaacgattttttcataaattataaagtaggaaattatgatttttatgtttaggatacgattaataaaaaaaaaattgtcagaaaattatgatttttaagaattaatttagttcactttcatgtcaaaacacattcttaaggtgggggacaggaatctaattttttgaatgtaaaaaaagttttaactacatattttacataaatatttaattatcaaaaaatatattaagactaatcaaatacacattcacacaaatcattattttatgaaatttacttttccagaaatcatgtttcccagatacaaatcaaagataaaaccataaaaaattatttaaaattagtaatattactatattagtcagattacaaaatggtgtgcacttaatcactattgagtagacatgataaataacctcatacttgtgagtattctctagaacttatcttgactttgatgaagaatatctactttaattacgtattattcaattttttaaagtaaaaataatatcaaattatattgtacatgtcactattacatttttttataattttttgtcacaacatatatatatatatatatatatacacataatattactaattttataaagattttattgttataattttcaaaaatataaatcaattaacttaataattaaataaaaacataattgaattctttattttttatcttttatttatttgttatttattatatttgtatattatttgaattaaaacataattaaaattttaatatataatttatttataaatatatgtaaattaaaattataaaaaagagtataacaggttatctacgatgataaaatccaatgagaatgtatgaaaaatttaaaccctcttttatttccgaatgcgtatcgcattttgcgagaacggagaggcaaatctgtccccgagcagcgccacccccattgccatctctaattaagcaaatatacctcattttgagttcgttctgcttatttagatagtatcaaagcttttcaacgagaactccattgcacatcgagtaattcttataaccaaaagcctcaaaacttcgacattagcttcaatagaaatctatcgtctgagtgactaatcagcaaattctagccaaaatcaaacgactaactaccatattcatccaaacaaaagttctactacgataatgtgacgctagatctttaatgtcgaacaataaatacaaattggtctgataaaaagaaagaaactatgaattcttttgatccacactttgaagctcaaggagtgatgcaacaatctgattgattattggattgcttacttagtagtctctgccttgatcggacaaaatgtgatttacatcagaaatccaagtatggcaagaccttgaatgtttctcgactctggctaacgtgcataccctctacatggtacgcacggtgcgaacaagaatgttttaaaatggttgtaccttgtgattttttttttttttttttaccgttaagatttaaagagaagagagtggtgaggcggtgatgaccatggaagatcttgcgttgccactgaccacaactttggagttttttcggtgcgatttcagcggcagatctgacgcttttattttattttatttagtatttaagttttgattcttatttatcgtaaatacttgttttatgtattgttgctgattttttgtattggtttctttgatttttttgtattggtttcttagatctgaatgttgtacgctatattcataagaaaatacatgttattatagatttgaatccgaagatctgagtttaattttcgtttatggatggtggttttatttatttatgtgggtgtgcggaagaatgatgatggagtgatggagggaagaggaggggaccgaagaagaagggtatttcgcaaaatagagaaaaatctaatgtagatagttctacagtagtctcatttattccaagatctaacggtgtaatatacacgcaccgtgcaacccattctaaaagtagtattcgcatcatgtatagccattaggggtaccccatgcaaaaagtcgccatgtttttcacatggtacttttgtttcgtgtatttggaacaacaagaactgtatgctttcaaaaggggatcgtcatcagtaactgaatgttttcactgaattaaaggtactttggagaattaataaagtgaactcaatccgtcataattttgttagatgcagttatgctagccaaaattaggttaactattcagttaggaggaaaatactaaggtcaatagtatactgtagaaaatttaactttatgccccgtttttagttcgttcacgatatttagaagtaatacatttgattcctagaggaaagaaaaagaaataataaatttgcaacaaataagccccctcgttcaaaataaagagaaataagagggagggaaagagaaaacctcgttccttacccacacggagaaagaacattttcaaaggaaaaaaaaacagagaaaaataaatagatgaacacaaatcatacaaaagtagacaccatagtccctacagaagttggcgattgcttgtttaatagttgaatggttgactggaggtatctgtctttggcactcaaacatgacttggcagtttcgaccagtgtaaggcaagcagacaataactcattgtttagctgtcaacaatcaagaaagaaaccattattagaaaactgaagtagaatctgcacatgattcagatacaactctgcaagttccaagcaaccaaattcatttggaatttgtggttacaagttacaacagagtatgataactttcaacaaggattcatcccctaacataatactaggtaaggctatgctaaaaatgaataattcaaacaagaaaatgttacgaattacaacagaacattatcatggggactcataagaaaacgcatattctgacttcctttttctgttccattcaatcattaggatttaaagataggtttaatatgtttgttaatccaacaaatacgacaaaattagattttaatccctaaaaaattataagttttggcccttatgaattttaagagttttgaaaatgattgattcctgttaccatttattgataacaaatgtatcgagaaagtgatcactgttgtggaatgcatagatgcatgtcaggccatccttaaataagatatatttcacccataaggccatacaagggtgaaacagaacaattttgttgaacctgagaaatgaagcaaacacgtatttcaattagttagttaggtgtctattagtgagggagtggggtaggttagttgggtgggctaccagggccgcgatagtgaaacaaaaaaggcatattgcctataaataataaataaagaggggaggttgagagaaatcatcttatcatttgagaaaggataatttgaatcttgaatatccagggaaatagctcgttttgtatcttcaaaacctagccaaaggctgctaccacattggcacagcaatcgtgatttagggttcatcaataaaaattcatcctttcctttataattatatactgaatcggtttctgacaggaacaaggacatttcatttgcctaccttttataacaaaatgctccaaactatattatataggtatagtgaacaatgtttattcataaatttctgtttatagttaaagaaatattaaataattaccatgaatgggattaatctcatggggatgccggggcagagaccatatatatacatacagacacactacaaaccagttaatgggttaactgcctgttgatttaaatacccatttgccagggtaggatgcctaaattggaaatagttttgtaatgtttttcaagaatttataaattgtaatctgagtcctctttttttcctttgtactttctccccacgtcaatgatggtgagaactaagttcaaaacaactacagagcagcttaccatgaaagatgatgcaatgcaattgcaagcttcaagtgccataattcctcgagcagcctttattttgttataataaatcagtattattataattggttaaataaatcaaacactattaattcagccaaaatgatgatacctgggaaggttcttgttgaacggcactaagcaggttttcaagaacaagtttagacaaagaaacaagctcttggttgtacgatgaatcctcatagtataacatgtcattgcctggaatctggaaaggaaaaaaatatattgttttgagaattaagatacaaaaaccataaaccataacatgtcaggaacaccttgatttacaaaaccgtaaaccttacacttgttatagtcagtgcaaagtaaagggaaggcaaattagattcactaacaggctcagaataattatactacattagcttaaccctagacctttacttatactggagctatgaccactaaatgacacttacatccactacttggacacaaaacaataagcaagacttctctaaatactcttcaacttcaatatgttttgtccattttggagtgaaagagtagatatgtcatctttattccattaatgcaattgaaaagaggaaatgcaaagctataccacttatacctgtgcatttgcatgatatggcagtctcttttgtgataaagttgtcaataataatatgatagcagaaaaaatttgtgtcctcatttttggttcaaacctgcaacggttttcaattcattcatcgaacaagatgcacgaagggagaagagagactaaaacaataagggaagtattttggggggcaagaagcttcgattgtgatatatcccaaagaaaacttaccaagatcgggagctgatcaatctaaataagctatttgggaaataggtgactggtagattaagagtaccttcaataaagttgaagaaaatcatagtaaatacatgcattcaaggaagaggtaaaaaggaactagatctctaacctagtacctatatatttctatacaaatcatagtaaatacatcccagaaagagagattttgaagtgtctatgtatattaatgtgcaaagctgaaacaatatttacaacctggaaccataattaagaagccacatagctttctaatagatgaaactagtccttcaacatcagttggagttcggaagcctacaaaatcaagcaaatcaacagtcaattatattataagaatgctatcgagagtacagacaaaagtcattttttagaaagccatggtggcacaattaatgtattttaaatacattaagaacaaaaaaatgctgatacaagcaaccaaaagaccaaagagaatgatgctcaataaaaacccctcgcaaaaatatggcaggtgtctttaacatattgtggcatccaattttgtattagttatttctaagaactattgctaggatacttgtattcaagaagagattagtgttgtttaaccacatttcctttttaagttctaacttttacgcattagaagccttgggtaacaataatatagggaaaatgaccctaaagtttggcactccaaaaaatttccatttcagttcgtatattgattgattaagcataaaactaatttaaccaaggatctacctattttagctctgatacatcattttcagttaactataaatatatattggattgctagtttctgactgggttaatcaataaatgaagtgaaatggaaaatattttcacaagttacacctacggatcatttagcattgcattattatagaccatgcatgtatataggttctacatcaacatcttattggagacttaactgtataatataacaatttccatgttagcttttaagctctatgttataagaagccccaatccttgttgggttttaggaatttgaaagatatacgaagttcataaatggcttcaaatcataagatattcgacgaagaggataaaagagaaaataaaaaaataaaaaagatgctcaaattattgtattcaaatcattagatactcaacaaaggggatagaagagaaaaaaaagatttacaaggttcataaatgccttcaaatcattagatatttgaaaaaaggggataaaaatgaagaagaaaaaatgcccaaattattgggctttcttcaacacaattgactgaactgagtcactaaaaaatataaaacaatttatagtttggacaacatgaacaagttttggttgtgaattgtgataattgttctcaaaaccttttaaccactaccgtttcatcatagcacatagaaaattagcattgaatagatttcacaaaatagacatgccacaagtaacaaatgacaaggattcaatttcaagtattggttcttagtactttcacaatgcatcagcaacaaatttacaggttttacatatcaactaaccatcaattatgtctaaggtatgcaaacagctgatcgctgaatcaatcaatccatctgaatgagaaaccaagccccctaagaatgcaacctgaaaaattcaaactatgaatccatgaaaaatataaaagtagcaaaaataaacacaactttgatgtgtcaagaactgacatacctacctctgcagtttctagaaaaagatcaaactgcctgtgagcataaatagaaggtattgtgacttcactaaatgtgacacaggatttgacaaaactcagatgtttcttatcacatttcaaagcttgaattgctaaagaattgctagagtgaacaagagtttcctgcaagaaagcatgacaactttatcacttataccagggcattttgccacaacttttaagaaaaacaaagacaaaccttaagctcatttaatctaccaaaagctcctcggcaatcaaccagaaatgctaaatggctttccatctctgttccatattctacctagtgaataaggcaatttagagtcaacattcataatcatggcaaaaacattaccacaactaaagaaagtgaccatagagacaaataatatcaaaaggaacaggttaccatgtgcacaaagcgagctattgaacatgccacttggccatcatcatcttttacgttcataatctctatattattatgtagtgtcagagaaatttcaaaaagcaactgtatgctcgtcggatcactaatgcgaccattcctgcttaacaaataataacagataattccatggtaatgaaatgaatacttaataaattatactcaccaatcagaaagatagaatcaagagtatgttgcaggcagctagcatattatgaaacaaaaacatttgaaaatgcaaaagtaaactctgtggtgtggatacatggttaagttttgattcaggatctggatgtaatttcccatggaacttttttgaaagaaaaaaatcccatcaattttaattgggtttcaatgaccttatttaatgttaacaaagctgactcaatgtcttagccttatagcagttcatgatttaagaaaatagaagttcaaataagatgtatttttcaaaattagatctaagatagtagacttggaagtgtaagtctgtataagttctgtgataacaattatctacgttagtgcagtcactttacagcagcttttatgtgcaagtacagcctatacaggggatttaggagaggaaagaaatgaatggttatatgaaattgtacaatgttagtaggaattttggtgtatttaatgcagcctaattttggatggtgagcttggagagaagaactcaacttttgagtggatttcaaatatcctgtgccaaaatgacttgtttggatatcaaatccaaagaattttaaaattgaggatatttttctggtaaaatgaagggatttcaaaatgaaaaaaaattgaaaactctcaccccaaaactctagtgcacactctatcactgttgcacctctctcccttttcctccctctctcgtatctatgcctctctctccttttttctctttgacaccactctctcttccacacctctctctgtctctccctttctcttcaacacctccctccctctctctcctatctctctttcgcgcctctttcttttctgcctcttttctccttttccccctctctctctccccctttctgacatacatcactttccctctcttttgcacatctcttactattttgcacctctcccctcctctgcctctctatttattcaacagtacggccttacaactcaaaagaaaatgttttttttaattgccacagaagtaaaggaatttgttaaattttaatataaaatcattcacatttcttcacctaatagcttaaattttgggtatagttggttcatcatatgatatcaaagcctctaatgaccaagcggtctagaagttgatccttgtcacactaattctaataaataaataaatgaatttcagcacaagataagtgaacttgcaatgttcacacttcaagccccacagcctctggcatgtggaggcatattagacatgtaatataaaatcatttatggtagttgttcatgacagagtttgtacacaaatatcaatcaactcaattaagtaacaaaagttaaaaattcttattcctcaaactctcaaagaacatacatatcatatacaaactagatgttggaaaactaccttaattgcggtcacccctagcccatctcagttgcagcctctttgagggctgcctgaattacagcctcaagggtgatggtttagtcccacatcgactagtgatatggacaagttaatgtaaataagtggagggaaaccctcaccttactagcaggttttgtaagacttagttaggctcaaacccaaaattctaagactagagaaccaaggtatgtcacatgggagtgtcaataagggtgatatggaatgaaaggagtagagtaaaacaaaatgtttgtgataaatggtaccttgtcgccatattaaggatatgcaaaaagacaacatcctgtgacttgccatacattacatctaagatttcaggaaaatgatcctacaaaataataacaacaaaaacccaaatcaccactagtatttatagcacatgtattgaagaatgaatgataaagaaagatgtaaaaagaaagatgatcaagtacaacaagatatgattaggaacataccagagaaaacacatcttccagatgcttaaaatgagacagaagcttcaccacaagagattgcaagctcgacatttcatcctctgtaactcctttattccaagtacgctttgaaatgccttccaaaatgattttcaaatggttatcctggcataaacaattgtatttagaggaaagattacaaaagaaaatattaaatattattctagtcatttgaaagtaacaggtatatcaatttgcaactaaactttgtaattggataacaattaatccatcaaggaccagagtttaaatctcaatattttctatggaatttctttaaattgtcatatatatgtttgactgacgatcgtctacttaaagaacataccaatagatagaaagaaagaatgcaaagaaaggaggataggctattgtccttgcacaaaaaagcttagaaacttagttccagaatttttagttatagatctcttgttacttttgggggattggcttgtacttagcttccttatcatttcagttcacagtacccttaccctattgactatttaatcaagacaagtattattggtaattcattcagcactaaggaatcaaattcactaccttcttgctaaaaacactttgccattaatttgttccaatatcggacatcaagcttcattcagaaggagcacgttcaatctctaggagattggaatcaagcaagttgtaaattaaaaagttcaaagcctgagatttagcaaatgggagttactgggaagcaacaaagcttgccagcacacccactcaacctacaaaactataatatgtcgatataatgcgtagatctagatgatgacgacacaaatgccaaacattggccttgtagaaaacatttgggtaatataatgttaactgcctagtcaagacaagcattagttgctcctaaagagtttcaaacctcaaacctctccttgctgaagacttacaattactcctacttccttttgtatctctttttttaatttaattttattaaaagaatttattgtgagaagaaaggatgtgattatagaatatcaatcaactgtgattatcaaattagcaacaaaaggataagaactgcattaaagcctagcttaacctttgaagaagttttaatattgatgtagatttaaaattgcatagatagccagaaaagaaagttgtgtagcttagaacatgaatcctattgagctcactaaattaatcaaacgtgcaccataaaaccaatgccttaagcagatagaaatttcagtgccatggtaacttggtaacatttaacacctgtttatcacagctttacaagaataattagtgccactgttccttaagcaatattgtcagttaaaaaatatctaaaccttagcatttaatattttaacagtcatagacataaaaagatgattactacaaatgcataaatttcagccaaaatcatctataccatgtaaatggtcaacaatttagtgcacccaagtgacccaacaaagaagatacataatggcataagaaacctttttcagaagacatggagaactaataacagtctgattctactcactcacttgaacttaccatctgattctgaagaataagatcagtataagcatctacaaccttcaggtatttgtcaaggctatcatacagagcaataacctaaagttgcagccaagttagagaacaaatgaaatacctgaaggaaatactgacagttgaaaacatgcttacaaatgaagtccatactaaatcgcacacattttttatagaggtaaaaattatcatatactcaaattgaccaggagtggagagcatagatgttggataaattaccaaaaaaaatatcttgatataaataagagggattactggtatgttaaaaattaaaatcggggagatttatgtataaacaagtcaaggtatatattatttataatatgctaaggggaagagtatatgattgtttagctttcaattaattacatagaaggctagaatcaaccctcaattatcaccttaccacgagaggaaacaacaaagaaaatacacaatttcccccaaggtgtagatggatgaagagatgaagatttaagaagaatatatgcaattgcaaagaacctaataatgtaactctgaaaggatgcaagatggactagaattttacaaatacctgaataactttatctaacacagcattgacaatatcaacagaggattttctttcgtacagcctgaatccaagcaatctgtaattcatatgctgtatcacaaaaaagaagaacattaaaaccgcaaatgggaaaaacttaaacgaagatgcctctataataaggtaaaatggtaaatactttataatgtgtacaagaagtatccagctatgatagaaattgcaaaagtatacctgatcaaaggaattatccttgctaaattcaatgagatgaaggatctgcacgacattagaactaactacttctatagggagttccttcagtaaatgatgaagaatgattgaaacactccccaaatccagttgattcttcatcaatccaaactctgataaaacttcattgacttgtctctttagcacagttagacatacttagatcagcataaaacataggatatagaggggagaaaagcagggaaaacattagcaaactgactttctttttcctactgtccagtttttgaaaagataacgacgacaataattcttcatgaagattaagatataagaattgagttttcattataataatgagaagaaccccaaccatttagctaattatatgtgcatacacctgtttcatgaaatttcaacctgcaattccactcccttgaaatgctcatggaaaattcaaaatagaagagcaaacatactaatcaataaaatttcaattatacacttttgtataacaagatatatggaaatatgatcatatataatacatccaaaacaagtatatttttgaagagaaacttcatcacatacctgagacaacccagtaaatatacacttcataatatactcaattgttggttccatcagactgacttgcaattttttgttgagtttaacatttttctgagttctttcattggctgacaagatttgcatcaaaacaactctgatgtcattgacacatgtaacaagatagcctgttccagttgcacaatttatgaaataagttttatgaaaataaacatgagaaagaagtatataacagcaatcggatatattaaattcagaatgagcaaagtcagtgacctttgcatcccatttcagaaaaggagcaagagaaaattaatcagaggcaactaagcactgctatagagcacaaaatttcatataggaaagagtatgaagcaataatctagattcattgattctgttttatctgaataactggtacaataatgtgttaaccagccgacttttcacattctaaacaacttttaaatttggaaatttatggaagaaatacaagaactttaaaccagagtatttgtgactgtactgacaccaaagagtatataatatttcacactaaggtcttggattacagttcataagggtgttagagcattatgataaacaattgcatatgtaaaggttagaccaaaatatatctaaatacatacagatcgtattttaacaattaaaaggggcccatctgcttcttgtttacatttttacacaccctaaggatagatatataatatcaacaaaaatacctatatcgtgtgaaggcagattctgagcacagtgagccatataaagacggcaatatgcagatgctactggatctcctaatcctcttatcatcattaccaagcgtcggaggctgtctaaaggttggtcaagcaaaaaccgccagcaaggcaatattgccagctccaagtaactagtacaatttcagataaacagtcagcaaataccagtcagtgagaaacaatctttagtgcaacagcttgtcaaaattcaaaatgttattgacaaaatctttcaaacttttctgaaaatatgtctatattgtagcaactttttcaagcaattttgacagaaaaaaaaaatgcttatcagttgtcacatcacattaaaatggcatcagaaagtctcgaaccaacacaagcagagagaagaaaaataacttcaggggaaaaaacatgtacggaataaattaaatacagggcataggataaggacttcacatgcgtggaagaagctcttgcacagcaccaattttgttgaaccagttatagcaagtttcttttgcatcagcacaaatatcccttgcttgaaagttttctacaagattcaaataaaacatttaagaaaaaagatgtgacttctaaaggaggtccatttatctcatgcagatcatcaagcttgtatgacatgtacaaattagttccaataaacaagatacaagatacaaaatgaaacatatttggtggcttctgatgtttgagatactgagaacctttttgcagttaaaacacagaatccttagtcttcaaaacattagcatgaaaaagatttaatgttgaaaaactattagcgccctcagacaagccacaagcttaacctgaataagtaatatttatataactacagattatggaagtaaacaacattttgtgatgagtttcaaattgacaaaggacctgctaagttgcagcgtaaagctccatcttcggaaaactcagctttccgctttatgcgttgccaaaccaggttcccaagcatatccatgatatctgtgacaagaacaaaaagtgtaggataaaactcgaatactgacgtatccatcagaagcttagcaacctgcaaacagaataatcagtttcagccctcataatcaatcaaaatcaagacaaacttagacaagaaatgaaaataaatcagtatgatttcactcccactccgaaactaagtataaaaatgagttatattttaaatgggtaggcccatctctctaagtccctagtattttaaaatcttgttaaacaaaattatacaacatttgtattctgtcatataaatattacgaagagtaaagaaagtacaggaggaaaagaaaatacaaaatggcatatccattttaaagggccgtcaatccctacactatctgataaaggggaaaatatattatcccagaaaaagggattatcccaggtctctcccacttttctgatgaagagcttcttcaatcagcccactcaatattccttcaacaatttactcgacaccctctcaaccccccaccttcacaattgtttccatctctctctccagctaaatggaataactaaaacaaaaatgtctcttttttcatttaaaaagccaaaaggtgattgcactcatacaaactataatgttgaaaagaaatcattaaatacataaaaattcacctttattgataactttaaggatgtcactcgatcttcagcaagccaggaacgagtaatttcatctttgagttcatgtagtcgagaaacatactcctgccaagtaatcgtcttgacaccctcatcagcaaatttttgtggatcgtccaattcctccaagtgcatatttgttgaagatttctcaagtactgaaaattgggaggtcacataactaagtaaagataaataaaggataaaacaaaaggaaaaacaatgtaaaagatattggcatacattttccacttctcattaaaacatcgggcatctgtaatttaaagaataaataattagataaatataataaaaactgaaagggttagagataaaggatcaaaactggtttaagaatataagggattatttacctatcttactttaagacctatcctctaccaatcaacattgcacaatagaaattacagatgtatattagtatatagtaattaactgctatatcttacacttcataagaatatttcaaagtttgtgaacttttttcaacagaaggttagctcatatgagcagtattatctggcgactagcatagggcccttaaaatgcaaaatcataaacaacaatgcccatacccaagcttgattcattatctttatagctgagaggtggaaaaaagaataatgaaggaacctaaggtgaaatatgagatgtattaataaatggttgaatatttagaaatatcttagtcaatatttatttttaagcacaacacgtattcacaactttcccaagtctgctcctgccagataatacacctcttccttaaaaatgtttaacgattgatatccgttaatgcagccgattaaaatatgttttaatcacatggaagccaataaaacagtatcagacagttctactgttttccaaacagaaaaatgtccagcctttccctagccagctaaaacaaagacacagaaagaatgaataacccttgcagaaggaggtaatgtccaaattcacactggttgaacttaacttgccagcagtatctaaattcacatctatgatctaacctgatctaccactactgacaattaagaatgttcaaagccaatctacagtgtcatcacaatgcatgcttccatcatatgcagcatactgtatttgcccttagccatcttagataccacaatatttttatttatttttatatgcagtatatctttaacatttacataaaccagaaaaagaaaatactgtaaaacttactgaagcaacagaaaccattttggagacaggaaacctctgcgttagtaatctcctgaaagaggtccactcctttgttggctgatgatcagcagcttcattcaagttgtcatgatcaggaggggcagcatttgcattattattagttcctcttagtggatcatagaaatcagtgttcccacgatctacgacatcgacctaaaacaaacatatcaacaaataaatgaatactgtcaaaagcgcaagatatgtaaaattttaccgttacaaatccacctaataaacacgaccacagttttttatatatattttcattaagcaagtcaacaaatattttcattacgcaagtcaacagaaattagtaagtcctaaattgtagttacttacgaaatccttcctggttcccgacctcccctcctttcctcagctcttagtgcactattgcagtgttacataaactactggcatgcaattcatgactatgattgtttgaataattatccagattacatcagattttacagaactaattacactcacattactcgtttcaacaatatcgaatcattagactatatcaaacaggataaaggtatctacacagggaaagatcgatagaatttaatttaactgaatgattaaaatcctaggcgttttcttatttcaggatgatagaactgaatcctaactctacgcaataaaataaaaaaaaaactgatatatttcgtggtgcatccgaaaccgtgaatgcaacaccgattctgcatagtcacaagcactgatcaagcaaggtagcgtaattgttttaaaagaagaaaaaacaattgcgagagaaattatgatacgagaaagacctgggagagaggtggaggtggaggtggagcagagagaggatgagctccggcgcgtaggcgagggagcgcgtgagattcaagctcggcactgtaatttcgatgtctgaactccatgaaagcattcagcaacgagagagggagagagagagggagggattcggggttttgtcttttgtttttttacagtgacttggacaaggaaaatgcaggatcagtgtgagaagaagctgactatcaaattaattattattatttttacaatttcatatttatatattaagatatataaatatcagtcaaaagaacttaaataatacaatttaaataacaaattacgaatttagggctatttcaaaattatttaccaacctgggcagttggtcacgcccaaaattgggcgaccgatttagtgacggaaaattcgattttttaaatttttttgtttgcgaccaaaataatttgtcggaaaaactgttagcgactgaaataaagatcaaaattggcgtgttttaatttttgacataaaatatcatttaatatcatttatttttatttttatttaatttgaaagtatttttagactcatcttcatcatagatatgatcttttttacttgtttttaatattgttttatttagtatatttttttaattttatatgactttatttaatatattctgaatttttggtatttataatttttagtatattattttatttaatataatttctaaattttatatgattttgtttaatattttttggattttgtatatataactaatatttaataaaatattttatttaataaaatttttcaaaatttttggattttggatttttcaatattttatttaatataatatttttggtatatataattttgtttattttggaattttaaaaaattgaaaatttttatttttgatacttctcattttttctaaatttttgtaaataattttttaatatagaaagcattttaaatagaatattatattttggtacttctcattttttatatcgagactaccccattaagcacattattctcatccctctcatcatctctttcattctctcataatttgataattctctttcaaaaaaagtagaagacaattctccttttctctttttgttccggtcaaaagcacaaagtcgactaacttgtcatcgaaattacaccgaaacttaggctttctgtcaatcggtgactcaattgtataaaattagtgtggtcaaaacatttacatccaagcgagaaagggaattagaaaggatcgtccatctttcatggtgaatgatcaattgtgcgagtaggttggtcaccatctttatctctctgggtaagcgcaatgcaattctttgcatttcaatttgattcacttttgtgtcacgtagttccactcctatttctagagttctgcaatgtttcgccgctccaagtgcgctttggaattaatggggtgctacaatttcgattattgtgtggtgagtgcactttgggatgagtggaacaagtggtaaagtgtggaatgagtgcggaaaagttaggaatgaatgtgctttgggataaatgaggttattatataaaaaatccaaaaaatattaaacaaaaccatataaaaatttagaatatcgaaaaaagttacaacggcgtacgatatgtccttcaaatggtctaacttttgatagaaatatccgatcgaggtgtacgatatgtcgaaatgctcgaaattaatagaagtaataaaaaaaaagcatgcaattaacttactgaataattaaaaaagcagaaaacaagaaaattttagatcttcgaagattaaatcacaattttgaggtacttagaggcctcttttgggaaaattttttgaccaagtcccctttgaaacttgccaggtgcttctcctctcaatttcgaacgcgtggctaccagtttcgcctcaatcggacatttcagtcaaaatttatgaccgtccgaagtttatatacgcatcgctgcatctgtgcatgacacgtgtcaggagtaggtcacgcccagaactgggcatgactggtcacgcccagcaccaggcgtgactatgcccagttctgggcgtcaccaactgccccagattggtaaatagttttgaaacagtcccaaattcgtaatttgttatttaaattgtattatttaggttcttttgccgaaaatattattagttgccgtttctgctggttgctgaaaaaattaattaaaatactttaaatgaaaatactttgtagattatgacaaaagtgacatctgttttccagattggcgacctaaatttaggtctctaaattacattccgatgattttaacaattttggtaattaataaatatttaaactgcttaataataataaaatacttatttattactatcaaaccaataagatatataatatttccataaaaatgtataataaagtgcaaattccatacttgtaaatagtataaaacacaatgtatgacaaaattgcatattcatattataataagaaaaaaaatcaagtgcacttatgaaattgataaaatgtataccaaaacataataaatgatagagtgcagattcataatattgaggtggtgtaatataagtttcatttgctcattttattgttgaatccatcactacatcttctcagttttctggtcataatttttgcataagttataccattggttcctcaagtgtcctctcctaatctcccttttgccatatatattagtctttttaccttttgtcacggtcatggtaaatttcatttacatattacccatctttctataaatatttatatagtaaaattgatgaaaaatggttcattaagaattgatggataatgtgttcactgggactaataatgggttacttctgtgtattgcaacacaaactttcgatggaagtatgaaacaaatgtgactgcgtcataaagtaatgaatataagaacgacaaactaagtaccaacaactttgttgtaattgctttggagaacttacgtaaaatagcaaaaagtgaagggaatttcctacaggtcacgtaagcataattttccaacttgtgtaaatttagtttatccttttttaaagcagaatacacgagttgtcgagctctcttccgaatggtggctaacacttttaggatctaaaggtagactcacttgtgacttattaaacgtgattcacgttaggtgaaaccctgtgttaccttactcgagtaatcccttgaagttagttgttacactctctttaccctttagtatataggcagagtctatgatttatatactttttatacataaggagaggaaatggtgtcttagttaagtatataatccaaaaaaacactaataaaaaacttacaattacttattaaagaatacgagtgagaagtcgaagatatatgacagcagtaagaaattccataattacattagtataatgccatgttggtagttttattctaaatttacagaagaaaaaaacagtagcgggcgtatgtttgtgtcagctgcgattgttctgagatcaaatgtatactatatatatatacacacacatggggattttgacatgttaccacttttaatagctattttattttttagatgcctgaataaaaagaaaatccgaaaaatttcaaagttcaaacaaagcatttctctaatccgggtcctgtagcacagctcttttcacattcccctaatattacctgtttatgcaaagtaattaattgtttttgttagaaactagaggtaatcatacttgagccggataatgaacaacaaagtctctatctaagcatttaactaactggacatacaggtctcaaattcaaaactacttaagctaaaataatttcgcaacaattgattcgcacagttagtaattaattagcacctttgttaaatttagcacactatttctcaaaaagaaagcgtgtgatcaacaaaaacgcacttgcggtctgaacgtgagtttgaagtttctaaattcttatcctctttgggaagtatgccagtactaatcaatccctttgagagactaataaagagcaaaagtgactctgcagcaacccagcaagtaaaaaacatgacgcaactagctgtactgtattaaacaccatccagaagaaagaaaaccccttcataagatctctctatgcatcacattttcccaacacaaagaaacacatgaagagacaacaaaaaaacatgccatcttcactcaccttaccattaaccattttgacagtactgtcttttctctccttcgcccttggccacgatgctcaaccctgcagtgaagcgttcctcaaactagcccaacaaaagaacatctcagcctgtaagacactgcgcactctgggggcagagtttgcttggtcctaccacagtctcaccaatgaatccatagaactagaaattatgttccgtgccacactccccaactcacaagggtggatggcgtggggtgtgaacccgggaaaaaggcctgagatgattggaaccaaagccatcatagccattaaacatggcgacggaacgtggaaagtagacacatacaacgtcaccaaagagaccagacacggttgcagccttcttccgtcgaaaatcgcgtttgtgaacaacaaatcagttgaaaaggtcgctaatatgaacaccatgtatgctacattggtccttccttctgatgtgtacaacgttacgaagctgaaccatgtgtggcaagttgggattgacattgacgatggacatcccctgaaacatccaacaactcttcggaatgtcgacagcacagaggtcatagacttgactgacaaaaacggtcgcagcactggacagtaccggagttatcttagatcggtacgcgagagctattttttttttattattctttgattaataatgcttaggtaaagatggtcatggtctttgactttcgacaaaggtatacctggttcaaaaaaaaatgatcatgaacatatgtcatcatttcaatagtaaatttaccaatcttacttgtctttgatccaaatcatattttattttattggtaaattaactttttggaagtgtttgtgtatggtaagtgttcattacacaaagagtggcaaaatggcatgactcaaactcggttaggccgaattcactcaataaaatgtagggagacctttaaattttgaatctgaattaaaatttatatcctttagtgtaattcgatcatgatctaatgtaggctaaaaaaaagtctggtgtttatcaaatttgaacctggttttagaagtttgaattgaatttggatcaacatgttaccattaactattcaaagattcactagtatttcaatgaaaattaggcatgtgaaactggtaaaattaaaaaaactttaaagatagctagatattttcaagaatattgaatttgttctgtttatagaagaatggcaaattcaacttcccacatgtctaactactaattaattaggtattagattgatatacatttttctttttctaattaatagaatcactctggtaaatatacctatacaatcgaggtgatcattgttacacaaataagaaataaacaacaggattagtctcatacgagaatgattaatttctttcctgtgtgttgaagaggcacatttaatttatacttatggttgtgcatgaaattaatctaggtacatggagtcctgaacattatcgggtggggaacactgttgccgattggaattataactgcaaggtactttcgggtgtttcctttcaaatgggagccaatgtggtttaacctgcacattggttgccaattaactggttttctcgttggcaccactggatgggctattgggttaagtctcggccattcttcaagatactacaccttccacactcatcgaaactatggcattctcattttcacccttagcacagtccaggtaattaattaattaatatttctttctttctatatatatatatatatatatatatatatatatatatatatcatgtacctttacaatatcaaatatcatcataaaaaattagctatttaattatctaataaagcgaatatagattatacagatatataaaggagattgtagatggatagtccgtttagggtacgtgtgggattaatatataaataggtctaaagggaattaaaatatttttttaaaattaattaatataagaagcatacttttaaatgatgatgaaaggtctatgttttaaaagagaaaatcataatagattaaaaaatacttttaaagaaaaaaaacactaaaaggaacctatttagatttaataattaattttttaaattatatatccctcaaaagcatgtgctttcacccttggttaagttgtagatccattccttagtaattaggtttagctctaaaatatttaattaatatatgctccacatatgttttaaaagtttaaaatatgtagttaatttttttgctttctaaaatgcatttagtataagaatttttattattattgaatattcgatagttctaccattatattaccaaaataatataagggctgaattatctgttaaaaaaattagtcacccactattaattttctaaccaacaattataatttatagtatttacgatttacatcgctaaatcctattcatatatagatttaacgggggaaaaaataaagaaactgatttaatttcattcttattaattgcattaattaatctctattaggatatacattgatgaaagatatgtgtttggttttcagatgttggcttttcgcttgaagccgaaggtgacggatgattaccggaaatattggaatatgtaccatcattttcttggttatggattgctggctatcatattcataaacatattcaaaggaattaccattttggaaggtggagatgcatggaagtggggatacattggaaatcttgctttgttgggtaccatcgcatttggtttggaggttttcacgtggattagcttcttcatgttgaagcacaagcagggaaacaaagccaagaacaaaccagagccagaagcaaaagcctaatatatatatatatgtgtgtatatatatatatatatgtgtgtgtatgtgagtatctatgcatgagcattacagcacgcgtcgaatatattgcctcaataatgtgtttttttattttttttggatacaataataatatgattgcattttttgattgaaaaaataagtagacattgacttgtgcttgtgggatagtaatttattttcctttttaggttgtttcattattattatatcgaacaaagaagacgagttaagaatatataaatatatatatatatatatatatatatatagatcgacctcttaatatatgtcattattaatatctttttatttatattaaaatcacttcttaatttatttatgttttttatctgttatttttattaatttcttctctattttataagaaatgatatatttattatgacatatttaattagtcttccaaataatttttaaataataaatttatttaatatttcaaaacagaaaaaaagtatttaataagaaaaaaaactagaaaatcagtatgaagatgttacattaaattataattaattaaaaaaatgtgttttgctatctccttgtttaagaaattatatcatttcttcgtaatgagtttgtgtgcgtgtacatattaaagttcgaacctagttacggctatcaccttatgtgtattatccaaatctttcaccactagtctttgtaacaagtgtatcacatatgatcttttgaaaaaaaaattatctctttcttttgataaacttacaataaggatgaacaaattcatatgtttagaatagatgtaaaatgaataagatgtatttagaaattagttattttaaaagaattcttcctaaatatataatacacatcacattctattttattttaaaattgaattaattttataagtttaaaaaaatttaaagttagaaatttctcaatagataatattgtttcatgatcaatatctaaccaaaggtcaactacattaccaatagaaaagatagtggtagttagtggaggacaaaataagttttggaatttattatcattctcccaaaaggatatcgataataatctcttaggtactgaaagtattaaaaaaaataccttttgagcactctacaaagtatttgaaattcgagaaaaaaatatcattcatataatatttatttttaaaggagttgcaaatggattcgttgatttctcaatcatggattggaactgctaagtccacattacagacaatattatatataattattactagaaaacaaatataaaagaatgttggaccatggaagttctccataataattgtgactcgttcccttaatcaatttagcttttaatataggatcattcaaaatatatattttattcataaaaattgaagataatataaaaaaaatttatgataaatcacggactctgtttaatcaaatgaactaaaccccttcacataaatcaaaatatttgaaggatctgttttatcatttgtcctaacaaatttaaattatcagctaatatctaaatgatcattgttgaaagataaatgaaggtaatttattaaaaattaaaatcttcatgtgactattaattaatttttaatcttaattatttaaggttatatggctcaaatttatatattttattcttaaatgtttacactaaatatttccccttcaacctttttcatttcataacatatttttttatatcattttttttcttattcatttttttaatttccttatctatccgtatcaatatttattttttcaattaacattaaatctttttatttcaaaattaaaaattttaaacatatatttaataatttattttatatttattactaataaaacaaccattctttactttttaatttatattttcacattttatgtatacttataaaaattaatattttattaattaaattcatgtttaaaatttatcaaaattacaaatttcaaacacatgtatttttattttttattatatttattattgataattatttcattaataaaacaattattcatttcctttttaagttatattttttccatatttgatgtatatttattaacatatttttttaataccatgtttttcatacatagatctatctaatttgttggtgactaattttatcgaaaaactatattgactacatttattgtgtctttatttcttatcaccttttattgtgtcatgcattaagaacctgtcttccagccgtgttaagagatgctacattcagtagttgccttcgtgtaagtgatattattagtataaaaatttggtttaatcaataagattgaagtgagttgattacgtgaattgaagattaacaatagggcattattcatggttttaggatgtttacatttttttatgttctgtacttcctcaagcatatacacgtccatctccgcaacactcactctcaccctgtctcacttcaactcactttttccaagtccggtccttccggatttttttttataaccaagtcaaattccttttagaattgcgtgtttgggtagataggtcagtagatcggtcacgacatcttgctcttattgaataggtgggacatatcattttgttctcattgaataggtgggacatgacatcttactcaagacattctaataatatgtactttaaagatgatattatcaaactaaccctgcatcaaaattaatcattccaaactcatagttagattaccttacctgtgataggtgttcaagtatagtataaggttatattatgtactcaactgaaaaatgagaagtgaggcaatgaaactcccaacaaacaacatcatccaaccaaaaactagtggcaggaactaacgaccacatagtcattgtcccatcttccacgtggatctattatcatgaacgatgcattccaattccttatcaccccaaaagtccataatttatggaaatcaaggtataattttcatcagcactaaaattgagcttcatgttagtggcaaacttatcggtggaaggcaccacatgagggagtttacgcaagccaatcttggcagcttcaagctttgcaagatccttttgagaagaagaggaggcaacaaacaccttagcaacacttgcatgtccttcccttgattgttttatatcaacatgcttccccttcttttggcacatctcatacaacatagtcactggttgaggctgtttctccaaagcatccggtgtcactattggctccaaaacacccctcattatctgccacaatcacaattattttcacaaaccattttttcatcatcttgaattatacagcaacttcaatgtaaaagtaaaagcttattctaaaaatcatttataatagttgtcattcattttcatcataatgaattgattcagcactgcaaatgaaattaaaaaccttgcctgataatcacttataatacttataattcgttatcatcgtaatgaattgattaccacaaaatatgtttcgatttatactaatttaagcatacgattttaaccaatttttgaatgtaatcctaaaaatactttatcatattatgcaatacaattttaaatatattttatattatgcaatacaatcttaaaaatattttatcctatttttgatacaatattaaaaaatattatatactatatttgaatacaatcttaaaaaatattttatgtaatcttaaagatttttattatattatcttatgtaatacaatctcaaaaatattttatcttttttaatataatattaaaaatattatattttattatatcatatgatataaccttttttattattaaattacttttttaatttttaatattataataaaatttatattaataaaattttaggggggcggtgcccaccctagcatgggcggacgcaggctatagattgggggacagtgccccccccttaaattctcaagaatatgtttaaaaatttttgggtaatttttttataataataaaataaagtaaaataaaaaaataacttagatgttttcacaaggagaaattgaaaagtatagaaaaaaaataataaaaaagatgaaaaataagagatgagtgagtgtgaatcggtatatttataattttcatgaatgcagtgaccacactcttgttatttttaagcaccagccacacactaattttttttctggatccgcccctgcaccctagcccccgccccccttatctccgcccctgtccgcaacactcactctcaccctgtctcacttcaactcatcgacaaacttttttccaagtccggtccttccagatttctttttataaccaagtcaaattccttttagaagtgcgtgtttgggtaggtatgtaagtaggtgggacacgacatcttgctctcattgagtagtgggacacgacatcttgctctcattgaatataactacacaagacatctttttgtagcaaaggtattaaaataaaaaataatagaacaatctaaagaaaaaaaataataaaataatcaaggataacaagattaaaaattatcaataatatttttagaaagaatatttgtttgtcttaatcatttgatttattagaagaaaggaactctaattatttgaagatcgatgaaaagataaatagagtttgatcaagattttttttttcaaatatcaaactcagataatccaatcgaatcaaccttattaagtttgccattactgaaacatgattccagtattgtgatgatgggagcggggtgtgtggggattttggcggtggttctgagcgaggaaaaggccttggctttgggcccagaaggcccacttgtggaagagttctgggacaccaaacattggaagagtaaaaattactatcaaaagacaaaacatttttttataatcaattgatattttataaaattactttataaaactagcttgaacacaaaaaaaaataaattaaatgtatattaatatatatatatattttatttttttgactttgaatatattaatttataaattattgaataaagtatatttgacaaacaatattaatataacatttaatattatcagtataatattaatataaatatatgaataaatagatttttcatatattttatgacataaatttgatatttaattaatattctataaaaatatattttcaaaaaaagtcaaatgaataataataaaatattcagaaataggtatatatattatatataaataaatattaacggtcatatagcaaaataaatttatgaaatttcaaaaagtattaatataaattactttattataaaaaaattaaaaacattaaaatatatatatatatatatatatatatataatatacccgtacatacatgataacagtgcgtgtttgattaggtaggtcaccacatcttacttgtcacaagtaaaacaatttttgattgtttcttcatttttaattatttatcataattttttagactaaaatcaattttatttggaatccaaacatgcccaaaatggctcttgattataaaggcggataatctttatctatttaatgtagaaacaatgtacatttaagtaactttacaatgtagtttttattcttaaaacacgagtgacattatgacttttattatgtggttcactgttttaattacatgtgaagtcccagcttttattttgtggtcgatctattgctttatttacatgtgctttatcatttgacatgtgttccacctctgcaaggacctgccaagtcggagttaggacttaatcatcttaatcattggaaacttatctcaacataatttgaacgccttgcaataaattttataaaaatgatggcaaaattttcgtcttgaaaaaaaaaattgtttagttataaaaaaacatgaataaaattccttttaaaagaaatatctttggcttagtagggcaataacatataataaaaaataaatgaatatatgccgctggaaatctaaatacgcaattatttatataaaaataaatatgcttaattaatcaaacaaaccaataatagttcaatggctacataaaataagggatgtgcctttatgactctaagatacctgatagacaattataatctagttccaaaataagatatcttaacgagggcaaatcaagtagtggtaaactaagatattaatgtaaatttaaggtttcaaatatttagaacctaaataaagaagttgaagttgttcaaaatattacatggctactgaggccatgagagaacaagtatatatacatgaatcacacttaaaacaactaaacctcattcgacagggcatcttatccttctctatgttgcctggttcaatgcccaaaagttcaggtggattttttttcctttttttaaaattaatataaagaaactattctatgtatatatatgtcatacttttaagcaattgattgtgaaacatacataggaatgttcaagaattttcttgatcctccaattcactttagtaaccacattcatcctcagttaagtctatatgtttatcatgaattaatttggtcatgttccccctcctctaaactttggtcattaattaatttagctttagatatgcatgtgatatttttctaatggtatttgttttctcatatgtaggtcttaaactgttctaattaattattttattttcacttgtatatgtttgactcaaataagatgttcggtaaactcaaggattataaaaattagaggagacattcaacggcctcccaccatagacaaatccatgtttaaatagtaacacaaaaaaaaaaaaagattaaaacgaaatttaagttcatggtatctagataaagtttaggaatcaactaggataaaattaaaatttaatatgtctatttgtagaagctgagataaaatttaaggtgcccaaaaatactctttttcctaaaaatataataattaaaagagtacattagtattttttttaatgttagtatatttttaatgtaagggttagaattttaaaattctgactgcacagttaaatccaaaatattgaaaaaattaggaataattttttaatttattttatggaaataggacaaacaactatattaataatgattttttattctcacttgttaatattattattttaattaatttaaatattagaatttatatgttgtaaacaaagattaaaatttctagcctaggattaagaattttttaataaactttcaatatagtagtatgttataagtggatgactggatggttaatatatatgtagttcggatggtctccaactctcccgcatttcctgcataattttttttcatcaaaatctcaaccgaacatcaagtcatctctcatctctggttagtgtagattcttccattcaatgggttcatatgttgttaaatcgaaaaacagaagttttgttcattgtgcatgcagcaggctacaaatgatcagcatgctaaaaatatacacaagatcatccaatggattttgcttgcacacacaagacttgtctcttttgcttgcacacaagacgaatcttttgcagttacttaatttagactcatatgcttgcacacactttgagtaagaatggatatgagttcttcaattgtgctcgatctccattgttatatatattttaaataatgcatgatgaactcaattatcaattctattcttgtactccacacttcagaaaagaaaaagacaaatctttgatgtgagaattgtctttcttcatttatttcgatttagttttttgttgatatatctagttctgttattttattcagtttagcttgcagttttatatatgggctcctagcaccctttttctcaccaaaaagccatgatcgtacgtgattatcttatacattttattttctattatttcttcaaatactgccaacttgatgtgattgtggaccttagggatgcgaatggaaggtcgaaatctatatcttagttgtaagtttttaccttcatttattgtttagactttagaagataaggttaatctttactttggaatttagttttgtcatatatctgtcaatgtttttgagatgggaccatgaatgaatgaaactaatatgaaattttggttgtctttgaatatgcaagggagttgaagaatattggtgaaaataaaccatcaaatgccacacatatcaaacgaaagtgatatttcaagcttgaaggaacgaaagaacattttgcattttaattgatgataactactccatcatcatgtataattaatctttaaaaaacgtactgtatacaatttcactattaaaattgttttactctattaccaaaaagaatggtaaacaaacctaaacatttaaatcattgtcttaagaaatacacagttgaaaatatggattttcaaaattgagattggatttgggtgcatttgatgcatattaaaagaagaagaatagcacactataaggaaattaaatcacattacaacattttgttataatgttgtttggttccacacttccacttacaacacaaacaattttatatggattcgacaatgttccttgttttcaagaatttgtcaaaattgattggtattttttattagacttaaatatttttttttatctttgatatatattagtagttttatgttcccgtcattttcttgttttagtctttttcctcctcttttctcccttcttttattttagctttttttctctccctttttccttatttttgatttatcattggattcatctaccattgaccccaattaagttagattaaaggtgttgttgatgttgatgtatatgttccctgatatttgaacatttttattttagatctatgtcgttagttaagtaataacgtgcactttaaatatttgataagacgatttgtgatgaatcaaaaatcgtcagtatttgtttcaaaatcaaattaaaatttttttacagttaagaatcgtcataataattaaagtaaaaaataaataaatcaaacaacaataatttggtcctcaccattagcgtcgatgtcgacttccaccagtgcaacaataattacaacatggtgggaaccacacaaatctagatttggagcaacttttgtttgtcacagcggaggaaaatgacagggttgaaggggatcggtcatcgccgcgaccttgttgaagatctaccatgttgcaccacacgaatccagatctgccacaactttcatctgccgttgcgaaggatgatgaaggggttgaaggatgagtggtcattattgcttcgttgtcgaagttctgccatatcgtgccatgaatactaatgtggttcttaccccttcattggaatcaagccagcacgcaacacactattctatgaatctcaattttgtgcaaacaaggaacccttcttgaacacccaattgaagtcattgctagaattcttgactatcgaaattgaaagggcaagctgccattcgttcttcaaaccaattccatttgtaagagcatgaatcatttttattccaacacaatactcaaatcgtgcctccctcgatggttgtctcgatgggggaaggtgtgtacgggaatttgacacgggagatttggtacatgcgactgcggtggcagatgcccacgatggtgacaaagtgagggcccactacggatcgacatcaatggagacatagatgacacgagagtggttgaaggtggcagaggagaaggtggtcacgaaagaggagggagaaggaatgaaccttctcttttaaaaaaaattgagatctattttaaatttgatttttaaacaagtacgatgatttttgattcactacttatcaaatatttaataaacacattatcacttaatttacggtagggatctaaaacaaaacttttcaaatataaaggaaaaggaaaaaattatcaaggataaaaacatagttaaacatttttactatatgagagaaaaagttagccaataagttatcagttaaccaatatttgaattatcgtctaatacctcatctttagttttgtaatgcacaacctatgctcttttttgttttgttcttttaaggagaatacacactatatctcattcatccaggttatttaattttataattaaaaataattttaaatgtatttaaacaaatcaaaaccgttcaaattcaaattgttggaccattcaggttctctataataattatgactcattcccttagccaatttaactcttaatataggatcattcaaaatatactttttatttgtgaaaattgaaaacaatataaaaaatttactataactcacatactctatttaatcaaatgaactaaaccccttcacataaatcaaaacatttgaaggatctgttttatcatttgtcctaaccaatgtaaattatcagctaatatctaaatgatcaatgttaaaagataaatgaagataatttattaaaaattaaaatcatcatgtgactattaattaatttttaatcttaattatttgaggttatatgactcaaatttatatattttatttttaaatgtttacactaaatatgtccccttcaacctttttcatttcataacatatttttttattcattttttttaatttccttatctatccatatcaatatttattttttcaattaacattaaatgtttttatttcaaaattacaaattttaaacatatatttaataatttattttatatttattactaataaaacaaccattctttactttttaatttatattttcacattttatgtatacttatataaaatttaatattttattaattaaattcatgtttaaaatttttcaaaattaaaaatttcaaacatatgtattttttattatatttattattgataattatttcattaataaaacaattattcatttcctttttaagttatctttttccttatttgatgtatatttattaacatatttttttaataccatgttatttgtacatagaattaccgacttggtcagtgactaattttattgaaaacttgattgattagtgtatctttctttgttatcacttttattttttacattacaatatttgaattcaagacatgtttaagaggatgaaggcattgccccagtatcactaggaccaacaattgattgatatttattaacatatatattatgtcgtttcatgagtattgattaaaaatattaaataaaccttgtcaagtattttaaattattttaaaataaacattaaataattcttattggaaagattgacagtcaaagatgttaaaataaaataaatactccctcttaccagtaaactatttcataaggattaaaaatttgattttaatctatataataatgaaagcatctgcaatgaaaattgctttaaaaaaaatattattttaatgtgtttaatgtgatattgaatgacttaaaattagagagttatttatacaagtaattattactcatgagttaactttataatagatataagagatataagtaaaatatttgttaattaaacaacttattaatataaatactattagagagaaaattaattgaattacttaagattgaagtaacataaattaagttacttagagaaattcataaagaataaaaaaatagactttttttattatcattgaagttgtattgaaaattaagagaagatatattgttaaatttctcaataaaaactttagaattttaatttcataagagaaggctaataaacattttccatataattaatagtgataaagttgaaagaattaggaggggcacgcacggtgatagaaacggggcgttttagtttgcatgcaaagcatatcatatcatgtgtcgcaggctccttccactacgcaccatttcgtcgcatgatagataatagtaatgaggaagtttgcattacaagaacaagaactaaaccccactcactcactcacacacacacacacacacacacacacacacacacacacacatatatatatatatatatatatataatactcattcaatgcacataataatacaatttcttagaatggcgaatttacccgaatccacctccacaagcggcgcgtcgtctggagctccttctgccaccggcaatgatcgcagcaggatggcgtatatggaaatcctcgttgtcgaactcagcaatccttttctccgagcaaactctctccatgagctctccaatgtagtacttaccttccgtcgtttttccactctcgtgcgtcgttttaatagtccaattaagtactgtataacaccccatttacaacgccccattattccatatactatatcacatgcgtcgtcgtttcaaggctcacacggttaatattttatatattttagatgagagacttatttgaggatcttgctccattattgtggaattcttttggtaccattgcagcaattttacaggtattattacttattccttttgtcactctttatctttcttgtctttttatatttttttatgaatgaatagccccataaatactgactaatattttgtttcttgaataccttgtttgtttcaaatcccagttttatgtatagtcttgaaaatttggttgtactttgacgcattttggtttgttttagaaacaatttcaaaccttaatagattttagatgatatattcattgttgagtagtgtaatttttttattataaaaagagagaattaaacatgctcctaatttatttatttttagttttttttttctcaatgaagaggtgcttctttgacctttgttgcccaccgctcactaggatttttttttcttccaggaaatagtttcagcatacccttttatttcacctccaggcctgactcaagcacactcaaatcgagtgtgcaaagctcttgttcttcttcaggtccactcacatatactttgtctggtctttctctccttttcttcaatgcgttcttactaacacatatcttttgctctcatggatatcttacagtgtgtggcatctcaccccgatataaggatggaattcctccatggtaatgatattttttcttattcacctgaaggaccgtgaacttctgtttggtaaataatattatttatgataaatagtatctttgaaaatttggtcttcaactgagtcaaacggcattgcatgattcatgtatttttgtggttgatgttgttcccaaactttgcttttgtacggtatatgttcaatacatataaaatgattgttgatatcttatcatctcctagatatattttccctttttttctcactaataaattttcttttgcatttatttaaaattgttataagatattgtaaaagcaaccaattgcaaacaatttaaaagtaagaaataatttgttaaactataaaatttcataaaagatgattaaaattgttataagttttcttttgcatttatttctctcctatttcttttaccattcttttcttttatcttattttctttttttttttattttattttctctttttcttctccttctcctttttttttttttttaactttcttgtatttatcattaagttcatttattatcaacctccaattaatttggattaaatgtaatggtcaaaagaccatacatacataatctaaaatgttttctgcctataaaacagaatcatgcagtcaatttttatatgcaacttgctctctctctatcttatcataagacttctactttatcttacttgaaaatgaagtttctctctctttcaatttataggtcataccacttgttcttctttcttagcattcagtcatacttatattttttttactgccaatatactttcataagcatccatggacagaaacttttgggcaattgaaaggcatattagttgttcttttgttaatataaaattaaggagattgctttgacattaccatatccgtttcagcagggtttttgctcattgaaactaacactttaaggaaaaagatatgactctttcactctttacacttacctttttctcatctgcagctcgtatacctctatatatgtatcccttgcttaatacaaccagtatggccaatccatttgagaatatgaggcttaccagtcttggagtcattggtgccttagtgaaggtactacgtccttgctgattctgttattgaatacactagactatgagaagaataattttttatacaacatttatgctgaacagagaataatttcaattagtaaattattgtcacaataaaccttgccataaaaaactaaatactacaataacctcaactaatatgtcatttaaaaaacagtaataactgattattgattattataaatctgtggcacacaggtaaatgtgtaaatattttagttgccacaaataattagtcttgttataatcttataatgttcatgtagattttcaactatttgttaagtttcaaattcattcctgtaataattttctatgatgtaacaggtacatacaactcaagttgttcggattagttcatcgctagtatcagggaacaaaattttccgaactattttatgcccttcaagatattgttgattttttttcctagtgggatgaagctattggttttttttttttgttgcttgtcacatgtacatttatacttgaattttgtcatgtgtttaatttcctttctgttgatatttcaccagtttcataatacagcagctataagtttccttctttcaacagtttcttccgctttgcctgcatagtatgcaaataggcggtgaattgtcaaaaactgtaagtttactgatcttgttttaaaccaatttggttcgataaaatattttatttggatgaattaaacttgatttttatttgcttcatttttctgagttacattttttgggtatgtatgatgaacatgtatgcatgtgaagcatgttccaatacaatgctacataggaggtgtaaggcaattagcataccatttatctgatcaatgagattacaactgaggaaagtggtcttggcataagataaatggatactatgtgaacttggggagggatatcatttaagaactctcttttttttcatcttttgaaatgttggtcttaatataagtttttttagtggttatcacaggactgttgaaactcttcttgacatatttggttgtagaagagtgctagcaatactccttttaacattctattattggttgaaatttgttgaaaatcacaaactttggtaagttccacttttaaattaggacagagactcatcaaacgagaagtaagaaccactattataattttcaataaatttaaactaataaaaaataaaaagaattttaagagtgttgcaaacactcctcttggttgtatcaaaatgcaactcaacaccagtatttgtagttacatgggttgaaataccccgtccttgatacttgagatctaaatctttaaataacacgtctgtttaactcttgcgttgtacttcttgtggtgcattgtaaatgctaagccatgtgtttgtttttgccactatctcgtgatcctctttttatgcctatcaaaataattgtaatgggaaaatttgtgtgtaatccaatggaagttccaccaactgcatgttggaacctttatagttgaacaaattctgtcggttgaaaatggtatgaaacatatttgtacttcagcagggcgcctttttcaagtatatatagttttcggaacgatggtggtaactcttgttcagcaaccttcgtgtagtcttttgaaggtcattattcgttgttatcttcgtctgtcagaaaatcagaggtttgttaagtagatagtaactccagttttataagggcaaaaaaatttaaataatgcgatttaattaaaaaattacgaaaatatggcgttttgaaatgtaattgcaaatctactgcgttcaaacacgtctggacaaaacgtgttaaaacacgtcgagctgagacgtgttaaaacacgtcctgggaggacgtaaatgaggctggaacacgtcctggctgggcgtgactttgccctagacacgtcctgcatggatatcgtcgtgtcggggtccaccaatgagtctacctgtgcgacgtatcttcagctctctctgtgtgtcctcattccacactgcctgtgaaatgtgagtgcgttgcctccgccttcgaagtacatcccatctatatggaccgggaagaacatgcgttgtgggatcgataggctcatgctcccggtcagagccagaacgaggtgactcagatgacgatgactcagccataataatatgctacacattttataattatattataatataaaccctaattttaaatacaaattatttaattcactaactatcaaattatttttacaaatttattatgtatctaggtcactatctgataatctacttcgtaatctaggtcactctctaataatctaactcaccaacgataaaaaggtctatttttgttctggtcacaagtgtttcaatatgctatataccttattgtcatcacaattagtcatctcatcaatattaactatgtatgtcaacaattttcattaaaaaaaaatataaaatacaagctcatttgtacaataactttaaattatgattttgcaaagaaaatgaaatatgactctacatgcttttttatttagagtttaacgttgatgattattaatgtaaaaaattacaatgttattataaacaattattttaaaaaaattaatataacttttaaaatagttattataaaaagccaataagattatcctagaggatggtttttgattggataataatataagatgatttacattgttagttcacaactttttttcttttattttatagaattaaatatttaaattttaaattaactattttaaataatatatggtatttaatgcatatttaatttcttattaggaagttatgaattaaaatttgaatacaattttattctttatataatcatagaattggtggagtgatataaatacttattatgttcacatataaaaaattcatttattttaacaaaacaattgtatttaattttttttctaaaattttattgaattaatactaattaattaattctataatttgttttcaaattgctacaattttgtaatcttttttaaattgtaattcattaatttttttccaaactaacaattaacctaggtcacccactaaataactattttaaaaatctacatcactaactaaaccctaacaactaacaagtaacctaggtcacccacttgtatcctaaaccatagaaaatatttacctaaaccatagacctaggtcctaatctaggtcactatctaatactctaagtcactaaataacaatttaagtaacaaactaataacaaacaattaacctagctcacaaactaactaactatttaacaatctaagtcactaattaaaccttaacaactaactatttaacaatctaagtcactacttaaaccctaacaactaactaacctagtaagcatttaagtcactaactaataatcaagtaactcaaaagaaataaaaatattttactactactaacttgatttatatagagcttcttgcttccttgcttgcaccctatttgcaccttccttgcactttccttgcttccttgcttcaaatgagagaaaaaaatttgagagaaagagagtttagagaggcagtggcaagtgtggctggggtgtgggtgtataaaaagggggagctgaaacacgtccctggggagcgcgaatggggactgatcacgtcgctgcagggcgtaaatggagctgatacacgtccctctaggacgtgaatggagctggaacacgtctccccacgacgtgatgcagtgcaagttgcatccctgcaggacgtgattgaacgctgaatacgtctgccattgacgtaactcaacacgtctcaggtgcccgtgaatgctttctgatcacgtccacccatgacgtgattcaacacgttcagctcaagcgcgaatggaagcagtagatgcgtaatttgatttcaaaatgcattattttcgtaatttcttattaaaatagcattatttaaatttttttgccattttataagtgcttctgcagttctgcccatgtcctttacgttcttcccaagtttctaataaaactttggtcatttcaaaacagagtttgtcatgcattaagaacctgtcttccagccgtgttaagagatgctacattcagtagttgccttcgtgtaagtgatattattagtataaaaatttgatttaatcaataagattgaagtgagttgattacgtgaattgaagattaacaatagggcattatttatggttttaggatgtttacatttttttatggttttggttttatttattcaggaacacccaacagctaggagatggctacagcagttgcttcataatattagagtcaatccgtttcctgcacaacaaggtggaggaggattcgatcatatgacggggtcgtgagaacaagactttctggggtttctacatatataaaataggattttcagttgggcatgtatagagagaatgaagaattgaatgggaagggaactatctttccgtttgatgttaagagtgaagtatacatgagctgatgagcatagtcacctcttaattgaatgcaaatattaaaatcataatgagccatatatttcaaaaataaaaaacttctcttcatctatatgggtaaaggagattgttagagattaaatataatatgagagtaaaataattattcatttttttcttttaaataatagaatgtaaatttagttccatgctattataatatatgcaaccaatagactggaaattttattccattatattccactttatctcattctatttctttttcatcaatccaaacaagtccaaaactcaccaagataagagtaaggaaccaattcgataattcagttgaccaatagaagaatctcctcaatcaaaacccattgatacctcgttgatcaaatcagacctaaacacacaatataaaacatccaagaacatacacaccgccaatcatgaactaaatgtgtcagggagagagaaaaaaagaaagaaaaaaaaaaggaactcatctcatggtggtggtcagcgacaaagatggcaaatttgcaactaatgcccaaagcattggatattgacgtggaagataagggggaagcgttaatcgaactggtttgaggaactcctcttttttctcaaaaggatcttgcaaagcttgaaactgccaagattggcttgcgtaaactttactgctgatgaaaattggtttgtgaaaataattgtgattgtgaggggtgttttggaggcaatagtgacaccggatgctttggagaaacagcctcaaccagtgactatgttgtatgagatgtgccaaaagaaggcttattctaaaaatcatttataatagttgtcattcattttcatcataatgaattgattcagcattgcaaatgaaattaaaaaccttgcctgataatcacttataatacttatcattcgttatcctatttttgatacaatattaaaaaatattatatactatatttgaatgcaatcttaaaaaatattttatcttattatgtaatgtaattttaaagatttctattatattatgtaatgcagtttcaaaaatattttatcctattttttaatgtaatattaaaaaatattatatcctattatattatgtaatatattcttttttattattaaattacttttttaatttttaatatatataataaaatttatattaataaaatttgggggtggcccatcctaacccccctatctcctcccctttccgcaaaagtcactctcaccctgtctcacttcattccaagtccggtccttcagattttcttttataaccaagtcaaattccttttagaagtgcgtgtttggacgacatcttgctctcattgagtaggtgggtcacgacatcttgctctcattgagtaggtgggtcacgacttttttttttttatacaataataatatgattgaattttttaattgaaaaaatgaagtagacattcacttgtacttgtgggatagtaatttattttccttttaggttgtttcattattatatcgaacaaagaagacgagttaagaatatatatatatatatatattatatatatatatatatatatatatataaagaccacttaatatatgtccttattaatatctttttatttatattaaaattacttcttaatttatttatgttttttatctgttatttttattaattttttcactcttttataagaaatgatacttttaattagtcttccaaatattttataaataataaatttatataatatttaaaaatagaaaaaatatttaataaaaaaaactagaaaatcagtatgaagatgttacatgaaattataattaatttaaaaaaatgtgttttgctatctccttgtttaagaaattatatcatttcttcgtaataagtttttgtgcgtgtatcatattaaagttcgaacctagttacgactatgaccttatgtgtattatccaaatctgtcaccactagtctttgtaacaagtgtatcacatgatcttttgaaagaaattatttctttcttttgataaacttacaataagaaaatatataatttaaaaatttagaacaaattcatatgtttagaatagatctaaaatgaaatagatgtatttggaaattagttgttttaaaagaattctccttaaatatacaatacacatcacattctatttttattttaaaattgaatcaattttgtaagtttaaaaaatacagggatttctcaatgggtaatgttatttcaatacttaaccaaagaacaactacattaccaatagaaaagatagtcgtcattactatagtggtgactgaaggacataatgaattttggaatttattaacattatctaaaaaggatatcgttaataatcttataggtatggaaactattaaaagaacaccttattaagcactctacaaagcatttgaagtatgagaaagaaatattattcagataatatttctaaggagttgcaaatggatcaatgagttccccaatcatggatggttctaaaacggctaagttaatgacaatactatctatagttattaaatataaaatattgttggaccatgcatgttctccataatgattatgactcatttccttagtcaatttagctcttaatataagatcattcaaaatatactttttattcgtgaaaattgataagtataaaaaaaatttacgataactcaaagactctatttaatcaaatgaactaaacccctacacataaatcaataaaacatttgaaagatttgttttatcatttgtcctaacaaatgtaaatcatcagctaatatctaaatgatcattgttaaaagataaataaagataatttattaaaaattaaaatcatcatgtgactattaattaatttttaatcttaattatttaacgttatatgactcaaatttatatattttattcttaaatgtttacactaaatatttccccttcaacctttttcatttcataacatattttttatatcattttttttattcatttttttttaatttccttatctatccgtatcaatatttattttttcaattaacattaaatatttttatttcaaaattacaaattttaaacatatatttaataatttattttatatttatcattaataaaacaacaattctttactttttaatttacattttcacattttatgtatacttatataaaaattaatatttattaattaaactcatgtttaaattcatcaaaattaaaaatttcaaacacatgtattttttattttttattatatttattattgataattatttcattaataaaacaattatccatttcttttttaaaaatttgattttaatctatataataatgagagcatctataatgagagttacttaaaaaaattaaatattattttagtgtttctaatgtgatattgaattaatttaaattagagagttatttatataagtaattatcattcacgagttacttaactttatagtaaatataggacatataagtaaaatatttgtgagttagacaacttattaatataaaaactattagagagaaaattaattgaattacataagattgaagtaatataaattaagttacttacaaaaattcataaagaataaaaaatagaaatttttaatcattgaaattgtattgaaaactagtatttgacctgcgcttacgcacgggttaattatatattattatgcacattatcgcgttaaacagtttaagattgatcgaaaaggtaaagaaaaatataaaagcaatttatatagatagtattatccatacaacttatggacataattaaatagtgcaagataaagcagataagtttaagagacagtggctacaaactgagacaacttctaactgaaccatgtagtttctattaacatgcatatttaaaagctgacaggtaagagctgttttttgcaatcaatacatccaccagtgtactatgttgctacttgggtatgaaatctccataataaactcgaagtcagcttttaaattgttggctcgtgcaaaagctttccaaccagctcctattttagcactctttctctggtggttaaacataatcttgcatgttattcttccttcaaaacagacagttgtgaaacctgtatccttaaggtagtaatacgcacgggttaattatacatttaaatgcatattatcgcattatgtaaaattggagatgaaaaaagaaaatataataagattcattaatgtgaaatataatatgcaaacattgtaacataagtttataatgttaattacaaaaaatatgaacatcaaatagaggtagttaaggaacacaaaaaacaaaattagaatttttgatttggttgactatatattttaaatgcgtgtaatgtaaatattcattagtaaaaatcatatataataagattcgataatattaaatataatgtactgaaatgttgatagatatagttaacaaaaataaaaaataaagctagagttcaactttggttgagttgaattagaaaagttacaatgaaccaataatccaatgcacaatgttgtttgttagatatgaaaactccatgataaattattttaaattaactttaattgtccaataacaaataattaaactattattttttaataatatattaattaaatattattatgtggttattgtaacaaataaattaaatacaaagagtttaaaaatttcaaatattgattaaatttaaataataacactataaatattttttttaaaatgtcaccacttaaatttactgttatttatccattatttatatgatgaaaatttaaaaataaataatatatttaataaaaataaatattgttgattgtttgatatgtaattatgaaataatgatgaaatctattgattggttaaaaaatatgaaataacagaatgacatattcaaaatgaaagttatttacaaaataaaaaaaaatcaattatattaattataaaacctgtaattattatgttagaaaagaaattgtccttaatgtcagtcttgatgtaaaaaaccatagtttcatgcatttaattcactttacaatcaatcaccttatccagaaagaactgaaagtagacaattgaaagaagacttccaagtgcaggaatgctagtggtcaggatcaaatttatggcattaacatacctgcaagaaaatagtacagttaaactaatgaactttgtctggaatgataatcatttgctaaattttattaaggaattcaactttgattgatcacaaacacactcaagaataccccaagggacatgtgtcattgcagccatttccatgtcaaatttagtttccaggccatggactaaggtcactaatgatgttgttataatgaccgagaattcatcctgtataattgcatagttctgttagaatgggagctgtatcaataagaaaaaaaaatcatttattgagaaggcattgatacctgcacttcagacatatccaccccatctgaatattgagggtcaattattttagaaacattttcaaaaagttgaccattttttgtcccaagaatgacttcctttgtggaaactgtatttaaaaagtttattcaaaacatcaagcagaaaagaaaatgtgaaagtcttatagctcagtccaattgaagaaaactgtacctaatcaaactgacccagaactttaatcgcgatcgaggctgagaaaatgagacgaaatgtggcgctgacacgtagcatccgaagctaagatttattgtgagcctgtcagctggattccgaagctgagaatgcaccaaaagttgacacgtacccagcaaaatgttcttttattactgtaatgtaaaaccaaaagaataaaccaccacaactggagcataccttcatcatcaccaaataaactgtgtttaagcttctcctcagcagttcataatcatgacagcattgcgcattgttgaaattttaaaaaataaaagacagatttatatgtaattataccattcaaacaatatgtggcacacgcatatgattccttcaaactcttgggagtacaaccacattacgtattaatgctaattgctaaactccaacagattactatataaaataaggaaagtcacacctagtaataaaagtttctgaatatgctttcagcctttgtttctaactggattcttctttcaatttctgcatcctgcaaatgcacgactcaagtttatgaatttttttttgattaaattgaataacacacctgtttcaaagaaaagcgtgaataagaatagagaaaccagacatgatttttcattcatgccaagcataccattgttccaatcctttaaatgcatttcgtcctaaagtaatcggtatcccaccaaacaattgcacaacttgcacatgagtgtatcaaaataatttgtattctctgatggcccaaaagagcaatgttttatttcttgatactgtataataaaatgtatgtgtcagtgaatgaaatatttttttaaaaattaagaaatggtgcgaagtacttcaaattagtccaaactcaacgaataatttgtttcattaaagccactgggaaggaagcgagtagattacttaccttttggtatacaacaaaaaaattgttaaattcatcaaatatgcgatctttgatttcactgctctgagtatcagcaaatattgaaactgcttgctttggagggttaaacacactctctgccactatactttgtattgcagaagcctgtaataaaataaggccctatcatgaacatcatgcaatcaacaaaaagctcatttaacataccacaaagcaaatattcaaacaattcatttagcccaacagggaaaccactgaaaaccaatcaaagaaaacctattaacatttctaatttgagatgcatcaattttttttgcaatgaacacgttcattacacaaagttccactcaacacagacataaggaccaatcctgacacaaaggcctgattacagcaccagctcaccagctttatgaatgcaagaaagaaaaactaaaagccattatttttctattttgagctaccttgccaggtgaaggttcgtgtccattccagaaaacataagtctgaatcacatccaaacctccgtccttggccttttgaataagatctgcccacatctgagaaacaaagaaaccccacaagttactaatgcaaaaaggaagaaacttttaaggcacccaatatatctatatatatataacaacaaagctaccgcatcatcaattcaaatctcaaaaaagagccacacaatatacctagcttacttccaaattccaacaaacattaataaacctggcagaaaggaaaaaaaatataaaatactactacgcacactgaatgaaatcgagtaatagcatctttagtgaaaaggggacacaacacacatacaaagaatataaaaaaaatggaacaaaaaatcacagcaaagcagaaaccacaattaaccacaactactaatgtaaaagcaaattacagattcctattccatgacaaaaaaaattagtgaaaatctttgtcaatagatccaaccaataagcatgggaaggaaataattgatgctgatattctgcgatgggcaaacagcaaagtcatcagtttgggaagtcaaagccgaatggatagtttcaaggtgttttgaatgtatataaaaaaaaatcatacaagtatctgctgcaaaggactgactatcatgttctttggtttacttttccctgatcttgttcattattaattattatttcttagaaatactaatattttgtttgtaatattagtaagatttttattagttttatgcctattccttgctgaatacagagctactgtacttatgtatgaaaaaaacaatcattaggggtcatactccctactcatctttacaaaataagtcttaaacatatatgcatgtctaacttggaatccacccagtagtcaggggaacaaaaaatgtgtcattttctcatcactcaattgaaagaagaaaaaaaaggtggaaagtttgagagagggaataccattcactggtatccagctggagccatagccgacggaagtaaagaccctattttttccaccttactctaccaacacaacattattgttccctcttcttaattctaaaaaaagaaaaaggaaaaggaaaaggaaaaggcagaaagcaaaaggtagaaatgaaccttgtggtctcttcttcagcagccatggctctcctcgttttccacagtagcacctggtggtagtgctctcccttgccaccaccctcaattccatctgaaaaaaaaaaccccacataacaaaagcgaagtgaaacgcaaagaaagagaagaaagagaacacactgttgtgtgagatgaaaatttatgtccggcaaggttaatcttctccttcatgaaaaccttagtgtcaaaatcgagcagcgcaacgcagggcccttgaacaccgacggtgcatcggtgaagctttagggttttccaaacgaactgttgttttaggtgagtgaaaatggatgatagagacaagagagtaactgagaaacgaaccgtgtgaaggaagaatagtaggtgaggattaaccagaaatgtcagcatttgagacgtgggagagagaaattgtctgattgatgaaggaaaaagagttggaggatgaagaagaaatttgaaatcttggagcgcggttcggatttgctgaaggttgctcgttgaactaaacaaagctgagggtgcgcatgtccctacagaggtttggaattggctgagaaaatgagacgaaatgtggcgctgacatgtggcatccgaagctaagatttattgtgaacctgccagctggattccgaagctgagaatgcaccaaaagttgacacgtactcagaaaaatgttcttttattactgtatagattatgaaaggatattgtactgcacaaaattagtaaaattattatgcattgtacacgtgtccattaccatattataataaatatacacgtgtccatcaccttgttatagtaaatgtacatgtgtccacggaactggacgttaacactcaacaatgtgtctctcttatcaacaacaacttatttgttgctataaccactctacacacttggaccatcagagtttggaaccaagttgaattcgtctattcaaatttccaggttttggtaagaataaatatattgttaaatttttcaataaaaactttagacttttaatttcataagagaaggctaataaacattttccatataattaataatgataaagttgaaagaattaggaaggacacgcacggtgatagaaacgagcgttttagtttgcatgcaaagcatatcatatcatgtgtcgcaggctccttccactacgcaccatttcgttgcatgatagataatagtaattaggaagttggcattacaagaacaagaacaagaactaaacccccactcactcacacacacacacacacacacacacacacatatatatatatatatatataacactcaatgcacataataatacaatttcttagagagtgaatgacgaatttacccgaatccgcctccacaagcgacgcgtcgtctggagctccttctgccaccggcgaggatcgcagcaggatggcgaatgtggaaaacctcgttgtcgaactcagcaatccttctctccgagcaaactctctccatgagctctccaaggtagtacttaccttccgtcgtttttccgctctcattcgtcgttttaatagtccaattaagtactgtataacaccccatttacaacgccccattattccatatgctatatcacatgcgtcgtcgtttcaaggctcacacggttaatattttatatattttagatgcgagacttatttgaggatcttgctccattattgtcgaaatcttttggtaccattgcagcacttttactggtattattacatattccttttgtcactcctagctttcttttgctttttttattctttcttgtcttttatatttttttattaatgaatagccccataaataatattttgtttcttgaataccttgtttgtttcaaatcctagagttttatgtatagtcttgaaaatttggttgtactttgatgcatttttgtttgtttcaaaaacaattttcaaaacttaatagattttagatgatatattcattgttgagtaatgtaattttttattataaaaagagagaattaaacatgctcctaatttgtttatttttagttttttttttctcaatgaagaggtgcttctttgacctttgttgcccaccactcactaggatttgtttcttctttctaggaaatagtttcagtatactctgttatttcagctccaaacatgactcaagcacaatcaactcgagtgtgcaaagctcttgctcttcttcaggtgagaattgatatgtccttgtcctatcaagttttatatcgtgtgttcaacatatttcaatttgccccaaatattattttttaactctaaaaatcaattggtttgaaaatgagtccagtccatggttctaaattgcagtagccatcgccgggcatgtaaaatagaatagaagattgaaatctaaatctttttattttttatttttttgggtaaataatcattttcgttcttaaatatgtagagtgctgataaattcattcccgtaaaatgaaaattcaaatttttgttcctgaaagtgaacaaaatgtgacaaatctatccattttattctcccttttctaattattgtaagcataaaattataataaacacttaaaaattaggaaaacaagtataagttaaaataaacataataataaatgtaatattgattgataagcataatttgtatgttgatctaaaatttatattctaacaacattagataatgacaaaataaagttgagtttcatttttttgtaaggattaatttaatgattgtattttaatttgtttgagtctcatattttaggtaaggtattatctcatatttttgctttgaaatttctaatgtgacagtaatttatccaaaatataagaccaaacaaaaatgcatagtaattaatttaattcttaccaaaaagatgagacctaacttgattttgtcattatttaatgttattataatagatattttagagtaacaaataaattatgtttattatacttattattatgtctgttttaacttatgcttattttcctaatttttaaatgtttattgtaatgttatgtttgctgattaaaaaagagagaatatgaagattaaattatattttgggtaaagagctgataaatttgtccctgaatatgtagtgcgttaacaatttggtccatgaatattaacgataatatatgaaaattaatggagagataaatttgttatatttttttcactttcataaacaaaaatttgaattttcatttttcaggaatggatttgtgatttttttttttttaaaaaaaaaaaagtggaatagaacggtgctaaggttccgttgctgctccaatatggttctgttgtggctaggtggcagcagatgcgttgcggaattttgtgtgattgaaattcacactgcaggttgcggacaacactgcaacaacaatattccgggtgcaatttagaaccatggtccagtcacatatactttgtcggatctttttctccttttcttcaatgcattcttactaacacatatcttttgcatggattttttacagtgtgtggcatctcaccttgatacaaggatgatattcctccatggtaatgatattttttcttattcatctgaagaccgtgaacttctgtttgctaaataatattatttatgataaatagtatctttgaaaataattgttgatatcttatcatctcctaattatattttcaataaatataaaatgattgttgatatcttatcatctcctaactatattttcctttttttatctcactaataatttttcttttgcatttatttaaaattgttataaaatattgtaagagcaaccaattgctaacaattaaaaagtaagaaataatttgttaaactataaaatttcatgaaagatggttaaaatttttataaattttcttttgcattcatttctctcattcttctttcaccctttttctttctcttttccttcctttttttttcaattttttcgtatttatcattgaatttatctaccatcgactccaattaacttgaattaaaggtgttgttgatgttgatgattaaaagaccatacataatctaaaaagttttctgcatataaaacagaatcatgcagacaaattttatatgcaacttgctctctctctatcttatcataggacttctactttatcttactagaaaatgaagtttctccctttcaatttataggtcataccacttgttcttctttcttagcattcagtcatacttatattttttttttactgtcaatatactttcataagcatccatggaaagaaacttttgggcaattgaaaggcatattagttgttcttttgttaatataaaattaaggagattgctttgacattaccatatccgtttcagcatggtttttgctcattgaaactaacacttaaaggaaaaagatattactctgttcactctttacacttaccttcttgtcatctgcagctcatatacctctatatctgtatcccttccttaatacaaccagtgaggccaagccatttgagtatttgaggcttaccggtcttggagtcatcggtaccttagtgaaggtgctacatccttgctgattctgttattgaatacactagactatgagaagaataattttttatacatcatttatgctgaacagagaataatttcaattagtaaattattgtcacaataaaccttgccataaaatactaaatactggaataacctcaactaatatgtcatttaaaaaacagtaataactgattattgattattataaatctatggcacacaggtagatgtgtaaatattttagttgccacaaataattagtcttgttataatcttataatgttcatgtagattttcaactatttgttaagtttcaaattgattcctgtaataattttctatgatgtaacaggtacatacaaatcaacttgttaggattagttcatcgctagtatcagggaacaaaattttccgaactattttatgcccttcaagatattgttgatttttttttcctagtgggatgaagctattgttttttttttttttttgttgcttgtcacatgtacatttatacttgagttttgtcatgtgtttaatttcctttctgttgatatttcaccaggttgataatacagcagctataagtttccttatttcaacagagattcttccgctgtgcctgcgcagtatggagataggcggtgaattgtcaaaaactgtaagtttactaatcttgttttaaaccaatttggttcgataaaatattttatttggatgaattaaacttgatttttatttgcttcatttttctgagctacttttttttgggtatgtatgatgaacatgtatgcatgtgaagcatgttccaatacaatgctacataggaggtgtaaggcaattagcataccatttatctgatcaatgagattaccactgaggagagtggtcttggcataagataaatggatactatgtgaacttggggagggatgtcatttaagaactctctttttttcatcttttgaactgttggtcttaatataagttttttattttacggattacgagaaagacaaaatcgatattacactgtacatactgaatatattagaaaaatggctggtgtagaaaattaatcccttctttgaattggtgggagtagatggaagaatgggattaagatccattgtttgtattgaaaaataaacaatggaatagactaggaaagtcatggaacccattccatccaatcctatcatttttagccgttttccttcctcaccaaattggggtgtatgcaatgaaacggtaaatatttttctctctcaacgtcatgattataatggttttgctccacgttgtggcttgtcctcaaattcatgacaggtatatttttcagtattttatttcgctgcgttcttattcttccttccattcctctccaacttgccgcgcacacactcaactaccaaatatcatggaaattacgtagatttaatatgaaaatttgataccttggcatgggttgcaagcaatcaaagaataaagatgatgttgagagagtgattgagcaactccagtaaacacaggaaataaagataaatagatgagattatgaagaatggacgtttttttttttttttttcaaaaataaaaaacttctcttcatctatgggtaaaggagattgttagagattaaagataatatgagagtaaaataattattcatttttttcttccaaataatagaatgaaaattttgttccattctattataatatatgcaaccaatagactggaaattttattccattatattccactttatctcattctatttctcttcatcaatccaaacaagtccaaaactcaccaagataagagtgaagaaccaattcgatcattcagttgaccaatagaagaatctcctcaatcaaaacccattgaaacctccttgatcaaatcacaactaaacacacaatataaaacatccaagaacatacacacagccaatcatgaactaaaaatgagaaaatagattgaggttttaggatcttaggtaccaatgagtggtccagattcactctccatctaaacataaatttgagtctttagattttaaataattaaagaataggaagctctacttgatcagaaagcaatacatgggaaaagtcaacccttcacaaattgacagatgtcacaagaaggttgaaaagttgatttcatatggatcggaaaaaattgtcaaagaaaaaaaaaccttgatttcatatgccaaggctgcgctatggtctaaacaatagccaatcacaacagaagatggaagacaccctaaaattacaacagaattctcttctacatataattagattgctgtaaggcctgaatcatcaaggaagcagcagagttttctgcatccttcacccgagatttttcatcccctgacatttgaagaataccatcagcagttggaatctgaactgcgcagacaaatttcttttcatgagagggacctgaatccttttcaatgctgtgagccattgaagagatgcaacaagttagtcaacaaggaatgttaaaagtttcactcacgcatgcaactgaactgaaagaaaatcatgttaaagaacagtacatgtactctggtataggccattttttaaccgcacaaatctcacgaagtttatttttgggtgcttcaacaaccaaggtaccattttcatcagcagtaaagttgagattcatgttagtggcagacttcttaacggtggaaggcaccaaatgtgcgagtttatgcaaggcaatcttggcagcttcaagctttgcatgatccttttgagaagaggaagcagaggcaacaaactctccaccaacaaacaccttagcaacacttacatctccttcccttgactgttttatatcaacctgcttccccttcttttggcacatctcatacaacatagtcactggttgaggctgtttctccaaagcatccggtgtcactattggctccaaaacacccctcattatctgccacaatcacaattattatcacaaatcaaattttcatcatcttgaatcgtacagcaacttcaatgtaaaagtaaaagcttattctaaaaatcatttataataggtgtcatcataatgaattggttaccacaaataacaatcacaattctttttgtcttagaatatgagtttggacctaatttaatcccaaaaactagctcatagggtgaggattattccccacttatatagtctatcttggtaaaatctctagctaggacttgggttttccccaatacaagccgcccagcatttttgggcttgaatgtgagtttggatccaattcaaccccaaaaattatgagggtcgttctcgacttatatagtctatcttggcactatctctaacccacgtgtgaattggatttttcccaatattttgtctagaccacaagtatcttctatcggaatgcaatcaaaatttaaaaccttatcaaataatcaaataataatttacattcattcatcgagagcacaagcacgcaacttaaaaccttatctgatttgttataaacgtgataacgaggagatataagaatagcttggcggtgaaagaaaaagggagggcggaaggaaagaaaaactaacatacaactaacataaaggtgatgatgaattgataaaaggtacggtaccatccatagtttctgaaggtcgaaattgacgtctacgtaaaccgcggcggcgacggactcgacgacgtcggcgaggaccttgggggccttgacggaaccgccgtgagagacggggtgattctcgagcttgacggcgtcgacgaagcgctcgacctggtcgacgaggggaggggcgctgtggcggacgtagcggtggaggccggtgcggacggcgacgcgggcgagcttctcggtgctgatgttggcggcgcggaggagggagagttggccggggtcgagatgagggtaagcgagaaacaagtggttgctgatggcgagactgagaacggggtctccgacgaactcaagacgctcgtaggagacagcgtccacgaaggaggagtgagtcagggcttcttctagaatcttcctgtttcgaaatccgtaccttaggatattctctacttcctccagcaaacacacctccatctccgcaccacaaccaaacaaaaacaacacaacactcactctcaccacactctctcacttcaactcaccaacaaggttttttataagtccttccagattttttttttatttttataattttaaaagtgtgacgaaagataaaaatatgaatttaatttttgaatatataaaaaaatatgataaattagtctcttaaatttataagattatttttttattaaattttaatatttaagaattaattttattataaattatatttttaaattaatttgatattaaattataatatttaaaaattgatttagtgtcacattatttataaaattaattttttatattttttatatttatgaattttaaatttaaatttttatcttttaaaaatcaatgtcatacatttttataggcgaattttaatatttatcatttttttaattacctgaatatattttgattttttttctaaaatcagacacgacataattgcagcagtaaaaattactataaaaagacgaaatatttttttataatcaattgatattttataaaattacttcataaaactagcttaaacacaaaaaaaattaaatgtatattaatatatatatatatatatatattgactttgaatataataatttataaattattgaataaagtatatttgacaaacaatattgttataacatttgatattatcagtataatattaatataaatatataaataaatagatttttcatatattttatgacataaatttgatatttaattaatattctataaaaatatgtttttcaaaaaaagtcaaatggataataatacaatattcagaaataggtatatatatatatatattataaataaatattaacggtcatatagtaaaataattttatgaaatttcaaaaagtattgatataaattactttattataaaaataaaatttaaaaacattcaaaaaatataatatacccgtacatacacaataacaaatctagtcatgtcaatgcgtgtttgggtaggtacggtcaccacatcttacttatttttccattgtcacaactcacaagcaaagcaattttggattttttcttcatttttaattattcaccataatttttgggactaaaatcaattttatttggaatccaaacatgcacacaatggctcttgagtataaaggcggataatctttatctatttaatgtagaaacaatgtacatttaaggaactttacaatgtagtttttattcttaaaacgcgagtgacattatgacttttattttgtggtccactgctttaattacatgtgaattcccagcttttattttgtggtcgatctattgctttatttacatgtgcttaatcatttgacatgtgttccacctctgcaaagacctgccaagtcggagttaggacttaatcattggaaacttatctcaacataatttggacgacttacaataaacgtttataaaaatggtggcaaaattttcgtcttttaaagaaaaaaaattgtttagttataaaaaacatgaatacaattccttttaaaagaaatatctgtggcttagtagggcaataacatataataaaaaataaatgaatatatgccgctggaaatctaaataccttataggcaattatttatataaaaataaatatgcttaattaatcaaataaaccaatagttcaatggctacataaaataagggatgtgcctctatgactctaagatacctgatagacaattataatcaagttccaaaataagatatcttaacgagagcaaatcaagtagaggtaaactaagatattaatgtaaatttaaggtttcaaatatttagaacctaaataaagaagttgaagttgttcaaaatattacatggcttctaaggccatgagagaacaagtatatatacatgaatcatacttaaaacaactaaacctcattcgacagggcatcttatctttctctatggttgcctggttcaatgcccaaaaattcaggtatgaggtggattttttttccttttcttaaaattaattaatataaagaaactattctatgtatatgtcatattttaagcaattgattgtgaaacatacataggaatgttcaagaactttcttgatcctccaattcactttagtaaccacaatcatcctcagttaagtccatatgttaatcattaattaatttgatcatgttccccctcctctaaactttggtcattaacttagctttagatatgtgatatttctctaatggtatttgttttctcatttgtaggtcttaaattgttctgataatattaattattttattttcactttgactcaaataagatgttcggtaaactcaaggattataaaaattagaagagacattcaaaggcctccaaccatacacaaatccatgtttaaatagtaacacaaaaaaagaagattaaaacgaaatttaagttcatggtatcttgataaagtttaggaatcaactaggctaaaattaaaatttaatatgtctatttgtagaagagataaaatttaaggtgcctaaatactctttttcctaaaaatatagtaattgaaagagtacattagtatttttttaatgttagtatttttttaatgtaataagggttagaattttaaaattctgactgcacagttaaatccaaaatattgaaaaaattaggaatagttttttaatttattttttaaaacaaatgtattaataatgattttttattctcaattgttaatatcattattttaattaatttaaatattagaatttatatgttgtaaaaaaattaaaatttctagcctaggattatgaattttttaataaactttcaatatagtagtatgttataagtggatggttaatatatatgtagttcggatggtctcccactcccgcatttcctgcacaatttttttccatccaaaatctcaaccgaacatcaagtcatctctcatctctggttagtgtagattcttccattcaatggttcatatgttgttaaatcgaaaaacagaagttttgttcattgtgcagcaggctacaaatgatctgcatgctaaaaatatacacaagatcattcaatggattttgcttgcacacacaagacttgtctcttttgcttgcacacaagtcgaatcttttgcagttacttaatttagactcatgcttgcaaacacattgagtaagaatggatatgagttcttagattgtgctcggtctccattgttatatatattttagataatgcatgatgaacctcaattatcaattctattcttgtactccacaattcagaaaagaaaaagacaaatctttgatgtgagaattgtcttttttcatttatttcaatttagttttttgtccatatatctagttctgttattttattcagtttagcttgcagttttatatacgggctcctaacaccctttttgcaccaaaaagctgtgatcgtacgtgattatcttatacatttgattttctattatttcttcaaatactgccaacttgatgtgagtgtggacctcagggatgcgaatggaaggtcgaaatctaaatcttagttgtaagtttttaccttcatttattgtttagactttagaagataaggttaatctttactttggaatttagttttgtcatatctgccaatgtttttgagatgggaccatgaatgaatgaaattaatatgaaattttggttttctttgaagatgcaagggagttgaagaatattggtgaaaataaaccatcaaatgccacacatcaaacggaaatggtatttctagctcgaaggaacgaaagaatatttgcattttaattgatgaggatgacttcatcattatctataattaatctttaaaaaacgtactctatgcaatctcactattgaaattgttttattctattaccaaaaaaaatggtaaacaaatctaaacatttaaatcgggcaaaaaattacaaataatacaattaaataaaaattttggcaaatggtgtaatttggaaacaatttagaaaatggtgcaaccaaacacgcccaaatggggcgtatttgaggaggtggtgacacgtggcagcaaaaaaaaaggggcgcgatgttttcgtaaacttcggaaggtcataacttttgactgggacgtccgattgatgcgaaaccggtggccacgcgctcgaaattgagagaaaaagcccttaacaagttccgaagaagactttcccaaaaaaatttcccaaaagaggtctctaagtgcctcaaatttgcgatttaatcttcggagccctaaaaaaaattttgttctctgatattttatctattcaattagtgaattgcaagctattctttatttatctaattacttctcttaatttcgagcattttgacataaaatacgtctcaattggacattgttacgagaaattacaactgttcaaagttatatgcatcgtcaattttacagtataattttggaaaacttttgcatttgggtgaatttgattcatattattaaaagaagacgaatagcacactataagaaaattaaatcacattacaacattttgttatgatgttgtttggttccccacttccacttacaacacaaacaattttataggtcgagcattggttcgacaatgttctttattttcaggagtttgtcaaaattgatgggtatttttcattaggtttaaacatatttttttatctatgatatacatccgaattttgtgtttgatcattgacaaatttttctttcgcatttgctccatggtatttgaaaagttttgttttggatttatgccgtcagttaagtgatgacgtatccattaaatatttgataacgcgatttgtgacggatcaaaaatcactagtatttatttcaaaatcaaatataaattttatgacaattaagaatcaccataataattaaagtaaaaaataaataaatcaaacaacaataatttggtcctcaccattggcgtcggtgccgaaccacttccaccattgcaacaacaataacatggtggcaaccacacaaatctagatctagagcaacttttgtctgttgtagtggaggacaatgacagggttgaagggggatcggtcattatcatggccttgtcgaagatctaccatgttgcaccacacgaatccatatctaccgcaactttcgtctgtcattgtgaaggatgatgaaggagttgaaggatgagtggtcattgttgcgtcgttgtcggagtttcgtcgtgtcgtgccatgaatacagatttggttcttaccccttcattggcatcaagccagcgtgcaacacaccattctatgaatcccaattctgctgcaaacaaggaaccccttcttgaacacccaattgaagtcattgccagaattcatgactgtccaaattgaaagggcaagttgccattcgttcttcaaaacaattccatttgtgagagcatgaatcatttttattccaacacaatgttcagaccgcgtatcccttgatggttcttggtggaggaaggtgagtgcgggaatctaacactggagatttgggacatgcgactatagtggcagaagcccacggtggtgacggagtgagggcccattacggatcgacgtcggtggagacacataggacacaagagtggttgaaggtggcagcgcagaggaggaggtggtcacggaagagggggagaaggaaaggacattctttttataacaaattgagatttatttatttttacttcaaaaaatttgagatatgttttaaatgtgattttgaaagaaacactgatgatttttgagccgtcacaaatcgtgttgtcaaatatttaacgaacatattatcatttaattgactgtagagatctaaaacaaaactttttaaatatcaaaaataaatgtaaaggacaaatttattgggcatcaaacataaaatttaaatatatatcaaagatcaaaaatatatttaaacatttttatgtaaaagaaaaagttgtcccataaattatcagttaacaaatatttgaattatcgtctaatacttcatctttagttttgtaacgcacaacctatgttcttttttgttttgttcttttaaggagaatacagactatatctcattcatccaagttatttaattttataattaaaaatagttttaaatgtatttaaacaaatcagaaccgttcaaattcaaattattgcagcatgcagtagttcgtatttggaccataggcaatcaaattccaattccctattattacacaaataaaaattaaataataaataaaatcaaacttatttccatatccctattattaagataaaacataaaatctaaaagataacgtcttacagaaaaaaagagattctcaagcaacattccaaggtaaattgaccccacaggaaataccaaaatataatgtctacgcaatgcctttatttttagagagctagataaagagacaaaattttgtattcttattagttgtcaaagatttctgtaaaataaaaaaaaaaaaaaaaagttgtgaaatattacaacttattatttgctttaaaattaaggggcaaagaaacttacaacctagtaaggttttggttgtcaccaacctcaatgaaatgacatgtgcatctgtgcacactaatataattttactattgtaatttggtttttctttttgtcaaaaaataaagtagagtattaaaatgttgaatttctaaatttaatgtttttctggattactaatagtgtaaaaatatctccacactccgctgagtgttgtatttgtcaacctcttaattaagctgcatattaataccgccgcagtaagatattgaaatttagtgctattctaatactgctgcagtgccagtcattggacaaatttggctgtctattctttgattctttgcacacacaaaaaagaagagataatgtgttaatagatatattcttatttatctaaaaggccgcgtctaaggtaaccaactaactatttcagaagagatggtaaacctagattcctttgattgatatatataagaagttttatgcaacaagatgatacacaacacgtccactgtgtctctaacatctagtatattttaaatttatgtctcactatcatataaataatgatatgggtctttaccaacattgtgttggtcttgagtttaaactttataataaatagataaaatatgatcacgagagaatattttattaacaaaaattaattattaattactaatattgataaatattttatagtacaatataataaaaaaataatagagatctcataacatgtttacctcatgtgaaatagacaggggtctataaacctatctaacaattaatgttcttgatgttaagaaaaatatttgtgctttttcggacgacaattggacacagctagtaaatgcataggatgagtgcattgccattagcatttagcaaccttaaatattaacaaaaatcgtgcaaataaaaatgcttttctcattgtgccaattttttattttcttttgtaaaattcttaaggggacagaaacatgataccccaaattagattaagaccctgtccactgtttagtttgagcaacgggtattaacaactgttggatcatatatttttctgtatatatattgttgataagatggattagacagaatcatgacagatgtataatcaaaataaggcttgatctttgtcaaattgaacactcgtcgtctttctttctttttttatatgcagctggcactatcaaacattacctggcacttattttgggcatgaagtaacactttaagaattctgcactgttttgaaaaaaattcgtccaattacatagaaaaatatccaacatgctgtttttaataagatatcccataagctggtcacgtcatcagttatcacatgacttgagaaaaacggaaaccgactcaaatagagctaaagaattaatattcttatgtattttttatttttactagttgactctaatagatcaattttgtgcttaattaactaaaagctagtctattttgacatgttaaaagtaagtagttgcattcaactcataaatggttagtgagaatacgtttccaagaactctttaaaactagtaatttataattgattttactaaccatgagtaatggttaaactaatataattctttattaaaaattacaaaaataatatattaataatattaaaaaaattctacttttgattccttaagcataatactataaacaattattaataaaactgataattactagttaactacttaattatagtttgtgcaaaccattgctattaagaggctaaagtagacttaaagtttgatgagttaaacagcatcaaagtttgattagttatacaaaaatttggttaggagtgcaagatgcatgaattgatatcacataatctgcatactgcatcttgtactttataaaacacgatagatatgaagcatacatcataatcatatacgcagaccccagtcaattattgatagtcatgcagaaatccagttacaatataattacatatgtcatgtcttaccaacagtgaactccaattacttttccagcctcccccggtcttattctcttcagtcgtctcccattaatttaagcaggaaaaaaaaaacaccacagtttattttcaatagaaaatgctatgttttaatgacatgcaactttttaattgttggagcatgaaaatagatgcagtaaaattcttttaacaggaacttagaagatgataatacagattgaaattagtaaacagacctgacctctaattccaaattagaatctgtacaaacccagtgggttaaaaactaatagaccctcagaaccagtgtttctaaatttaacaccctggaaataatttattaaagagagaaaaagctaatgcgttcctaaaaggcttcctgataaagccaagaattctctctctgcatctttaactggttgtagaagttcccaatgaaggcctcagcttttgcaaacagctcttgcccattaactcccccaacctcatcttcagcttcaatctcctcatccatgacttctccttcactttctccacctcctatgagcaaaagatttggcattgaaggacactttttcacctcagtgacaccaacaatcttctcatcagaagcaggcttttcaacaaccttaggcttcttttcatcatattctgaggcacccacttccaccctttcctcaggttcatacacttctgggggcattacaggtttctgggtgacagaaacatgttgctttttgtcttctaaaggcttagaaaaaactgagagaagaccagcttcagctccaagtgcaatgatgagaacgttaaagatgaagtaaaggtaggttggtctcagagaggaaggtaacaagggtgtgatcccaaggagaagagcaaggacaaagagcactagaagttcagatttgttgaatttgttcatgacttcggtgaatgcgagtgaggaagttaaagtggccaagaggcaagaatgaaataaatgataaaaaaaagatggacagaataaatgaataattaggggtagcaggaagtaatacgtaggaataagtgtatggggttctggacatataaatagaggtgagggagagaaagacaaacagtggaagcagtcacttgcatcagtgtatgagttgttgccagtgtcagtcaacaaaacaacaaaaatatttgtgggggctgaaaattccaacaaaactctcatacattatagtcaataaaaacatcattaggcaatatatatatatatatatatatatatatatatatatatatattacagtgcaatattattttagtggagagaacacagttattttttaatccattatttaaaagattaatcctacttgtgaaatgagacatatatattattctttaaatacgaatatagtgaaatttttataccattatgatgcaatatttgttaaatgtggtgtaataccctttaattataattattctttcttctttatttaaacgaataacataatcaagtaataatggatcagtttaattaaatttatttattaaaataagtatttattttaataaaaaaattattttaaatggataacataaacaagtaataatgaataagtttgtttgagcttatttattgaaataagttttattttaataaaatagatatcattctgtttttttgtgtatttatttaaataaaatttaattttctgtttattttaaaaaatcgtatctatttcttaaaaaaacatattttaaaattgttttttaatttaaataaattcactcaatattttgtctttcgttgataaaagtagttcgattctacattgtccaccaataatgatgttaatgaaatatttaatccaattcggatggaaattaaagccagatagatctagtttagtgatttactacttgcaaaccaattgcatgatgttgtgaactgttaaaagcgttatcaatgtcggcacatgaaagttacacaacacaaccacttggagcattttctttttcctatctttactctgtcgtgtagttgattatgtattttatccgaatgaccacattaggaacaaaatattaagttgagctttggcacaaaactgtgacaagatgagattatagcctaggagttaaacttgttacacagtgattagacgagaaacaaaacaaaaacaagggacaaagggaaccatacaagagagaaattaatttggacgttatttggatgttgcgtgataaggcctgtgaaagcatattcgtccaataaggttttcacttttttttgtgggcgttgatatgattttaagggaagaaggtaacctctctttgaactcttcttggtcctgttcttaaaagccgtcggagtggtgggtcccacggttctgatcctatgtgattccaccccagagaactgttaattaaagggtaggattaggacattttgattttggaccccctaataatcatggaaaagcccaactttcctctttttgttatggactgactaaaatttgggccatttttacacgtaagaagcccaaaagttaaatcccgattaaccctatttaaccaaggattttagaaatgaaagggtagaccaaggatattatgaacagtgttgtatgcacattaaccagagtcatttattcttaagccagctgaagtgtctaaagtttattaactaatgagactttttgtgtgtacaataatgataatgaaacttgtaatacaccctataagagagacatggacaagctaaaaaatgagaaaaggattgagcatgttatcaagaaaaaaatggaaagactttcatttgagaaggagaacatataatgtgaaaaagactcgcatactttcatatgaagattgttagagtgacaagtgtgagtatatttattggtcaatataaattgacatgttgaataacatataacatgaaaaggatccaccaatttaatgttttaagcttttgacttagatgtaatgttaagtttacttgaactatttgttcatactcattaatgaaagtctgccagtgttttaccttttcatgttccataacactatatatgtagttgaatccataattgaagtatcaaaattgtgcataattccgtgtatgtttcatttagcttttggcatttgggattcacgtccaacttgaagcatctaaatgttatttatgcgtccataacataaattccagaagcattaagttttgcctttgaggattattgatatacactctaaaaaccccgttgtggccttgttcaatcataggcatcctattgaaaccgttggttggctcttgcaaagtgaaaagtctaaagttctgccctttttcttctcttcgtacatgtctttgaagtctttcggcttgttataaagggaactgttggttagcttttataagtctttttgtatacagggagaaaattttgataaaagataacgtgcttgctccttgctggtcaccccaataataataaaaaattctttggaaagagaatgatgaggatatgagtgaagcaagtatctttcaaaggttatcgttttcagaatttaggttctaaaaggaatttaatttctaatgaaagaaaacgttttaattagcagttcgtaaataataatgtaaaaattgaaacattttttttaatagaagcaagattaaatagagttcgaattagcacgacattttttaaaagaatattcctatttaataagtggtattgacgatattaggatctccctaagcattcaaatgtttgaataaaattctatggcccgcataaattttgattttcttttcgtttcagctgaatcgtagaattttaatactcaaatccatcggttgtttggctttttatttagaaaatgagttatcacctttacgtagaagaagaaaaaaaaccaattttcctacaattcctgcgacagtggtggtcaatgtcaatgccaaatgacgatagcgagatgctaacagtgatctagcctcgacaactgtgataaggaacgcatataagaatgtggcaatattaatcatcatagttattggaaaatgtcataacaatgactttaaaattataaaagcaacaatggtaaattttaattttaacttttcaacatttaacaccatagttattattggtaaaaaaaaacaccatagttataaaatttcatgttcagaattaaaatatatctaatataaattagtaatattaattatgacatttcccttataatcaatatatataatactaattttgattttttttctaattttattttgtaatatttttagtttattgtttcattttatttttattaacttttcatttattttatgtacatttttttaatccttataattattttaaaaaaataacaaagaggattatagtaatttttacataatatttttttattataaatacatattatatagacaaaagtaatatatatatatataagtatatatacaaatataatagtcattaatataattttttttacttataatgttaataacctcacaagttttaataaaattaaaataacatttacttaacttaatttttatatatttctttgatattcattttttatttataagcataatattaacataaggtgagtctaattcttgccaaagccaataaaaataaataattatttaatttaattctaccttttgtatgcttcattggtactaaacttgaggtttgtttaagctaatcttattaacaaaagaaacaagaatatcttatcaatacttaacatttttttaaatagagatctcttgagtagtatagtgatatagttttttatttaatttttttgaaggaaaaaaactactcatttgatccatataattacacaaactttatcttttagtttgtgtacaagcacttttggattatttttagtccctacctttaaaaaataataaggccattaaaaggtaaattttgtataaccgtaaaagtaggaactaaaaaagatataaaagtgcttatatatacaaggactaaaagtgaggatttttaagtgtgaaatctagaagataaaatttgtacaagtataaggactaaataagtagttttttcccttaattatttaatggagggtaaattattttatatagtaaaataataaaatttaaatgagataaatcaaataactaaaagttgtcatttttttaatgttattttgcattgacaatatatgaaaattaaagtcatatcattattaataatttgtatataattaataatataaaaatagcattacattttttctttcgagcagtatatcgtacgaccatgaaatctagttgtaatttcaatgtattcaccagataagatgattaaaattcgaatgtaacaactatggtttgaatactcaattccaaagttggatgtctcacgaagtgtaccttaatattaattgcaagttaagaaaagtggactcgttaaggttaagcctccaaacagagggcagtgtctgtctttgtcttggtccctatgagtctgggagcggacaaaaaagagtgtttcttagtcttaagaaataagaatgatcccttcatagatgcctaatcttgcacgttatttttctgccttcttctgtactccctccctagtccccccacatcattcattcaaatccacatcacactagggaaataaaataggagacaattttatgagttaatttatttataatatataatgaactaatatattttatagattttattttcacaaacacttactattttaagctagtatatatgtagaagtctaatgttttgtttagtgaaggagatgaaaaaaaatattaatttaaattaaaatagagtataaaaaatttgaaattcacactatttgaaattgtctatttccctcttactaaatggaggctgagagatgatatgttaggtagtctataaacatcaacaatgcatctacaataagaagagtcgtgttatgggagagtgtgatccacataacattaagtatcgttttacatacaaggctcgtgcatgggggatacttgagtgagtcaagattggaatatgaggctagctagtaatcgacccaagttgtgatctaggattttgccattgttggcaaacacgaaagttgagacatatagcagggctaaattcaatatggtcaaacgtgaattatattcaaattataatgtaaatttatgaattaaagcttcaaaaggaaaaaaaaaaaaagattgatggaaaatattattttctaataagacccaaaaaaagacattaagtaaaatttatttctgaatgtgttagacaaggcatgttaaatgggtcaagaggcttaacattgcaattcaacctaccaaaataaatgggttgactattttcactcaatggataagtttgttttaccatccctactaacacttttaaaaaaggttggacatttctccatatttaatgttatatcatattcaagtaatcttattaatataataaagatatgagaagttataaagagttataagtttattaatataataaggatatgagaagttataaagagttataagtttatcaatttttttttttaaaatacatttgtccttaattgttattagtggtaccaatgaactgaatcaactcaaaaataatttgaaattcgagttgataatcagttcgttaaacttgattcataaattaaatgagttgaacttgagttacgtataattttacccgtttggtttatgaattgactccacacatgcacatacacacacacacatatatatatatatatatatatatatattaaatttttataattaaatgaattttctattattttatgtatgcatgatgaaatagttttatttatattaattttggttgtaattatgattttttattgttatatcttatagttctataaaactagaatacattcaatttttttctttaaaaaaataaacaattattttatttaaaatctactaataatttaaaattttaaaacgtataggatttaaaaatttggactattattcatattattcgaactaacgagcttaatcgagttattcacgagtttaaactaaatcgagttcgagctaataaaaactcaagtcgagtttcgaactaaattaaatattaatgggttgagttaaactcaagtgagctcaactcatttttttcccataattgttatttatgtattggtattgctatttatataaaataaaactttgtgtattagagcttgatatctcatatcccatctacccaagatagtagagtattgttgagaattgagaaatatggtaaatcattcttattagataagattaaaagatattctactatcaaaagaaaaacatgaaaatattttaataaactaggtcttgtgatttcttctttacatatacattgagaaaactttttaccttctgctcgtacacttatttgacttccatttcatgtctgttttaatttaacatcataaataggagaattaatttggtctattattaattttcaacacccaaacgtcctctcacgtgagtgtatagctttgtgcttttcagtggtgcacacatgcatcatgtggagacatgggttgaggattggaggattgtgtttgtgggctcagagaggaccagcagaaattaattaaaagagatattttggtggccattcaattcaccctcgaagtttcatggactggaattttctgtttgttggtagagatagagaaatttcagagcttcttcccatacgcattttaggttgccacaaattcgtcatcaaaattcaatatagacaagatatgtatatatacacagcaagacttcttcaagtccacaaaatgttataatttttatatacaaaactaatttatattcgtgcgtgagagaagatttacgtgtatttattttaacgcgtcattcttttcttctttctcaagttaaacgtatgtttttggattggttgaaaaaggttttgatggagactctagtacagaactatgtaaaaattatgaacaactttttctatttactggtggtatttatcaatttgatttaagtgattatttaaaaaaaatcatttcttaatcttagaattaatttatgctaattctcatattcaaatggatatatggccaggaaaattaataaaagttcaagaaaaacacaaatgaacgataactgaagtttgtgaaatatttgggataacattaaagtttgaaatgtttatttacgaaaaacataaaaataaaagcataaaaaatcgttgaaagtaatttataaacaaagttagagggggaaaaacctaacaaagtcaacatgatcgttgtgagcttgagggaacttcacgtacacggtaaatcatattaaccatttttatattagggtaaatagatattttgtcccttaatatataaagtgttataaattcatatctaaaaatgaaaattcaaatttaaattttagttatcaaaaataaaaaaatgtcacaaattcattcatctgttaacacgttaatgaaagagtctatgtggcatattcagagacaaattaatgggtgaattttgttagctctttacacattcaaagacgaaaatgactacttacccaaaatataatttaatttttatttttccctctttaattgttacaagcataatattacaataaatacttaaaaaaatagaaaaacaagtataaattagaacaaacatattaataagcatagtttatctattattataaaatttctaatataatagtaccttacacaaaatatgaaattcaaaaaaaaattatgataatgagacctaacttgtttttgttattacctgtcataataaaaatttctgagacagattatatttattaattaatattatgtttattattatgtttgttctaatatatgttttctttcctattttttaagtgtttattgtaatgttatgtttgcgacgattgaaaaaaaagaaagataaagattaaattatattttaaataaataatcattttcgttcctgaatatgtaaagtgcagataaattcgtctcttaaatgtgtcaattaggctctttcatggtaacggacaaaaattaacgaatgaataaatttatcattttttttactttcaaaaactaaaattttatttttattttttagagataaatttatccatactctacatactcatgaaaaaaaaaactatttaccatttatattatatagttatagtacttattttagtcttttcgtccacgggaaagcaagatttccacgtttttcagtataaattttaaatccgcgagaatgagttacgtcatgcgtgaagccgtgaatacgtgattggcaggctcatggggataaataagttacttgttgcgaaagttcatgtggtactgcttcagccaataggtaaatgtgctaacaagttacttgagaaagtaaaagaggattttttatgattattataatacataaaactacatttttctatcatttacagatacatttttgtataacttttaatatatttttaaataaattttccttgactagtttcaaaaaagcaaacattgattaaaaaaacccttggcaatatttcatagaaaaatattgacgtaaaaagagaattgtttcccagcataattgggattggtaaacacttcgatcggtggattgttatcttactagtacttctaatttttcaaacaaaaagaaagtttttttagcatcccaaatcttacttcagcggtggctaattatgaatctagataagagaaatgctactaacattgttcgaatatattctcttaaatgcagtatttttgttattaaatgaaatttatcatattctttatttaatgaaaaataattatgattttgtaatttaaataaattttaattaataaaaataagttaaaaaggattttttgaaaatttaaaatttcaactaataaaaaatattatattcaaaaaaatgtattattagtatttctcttaatcctatctatctaaatcaatactaatggttgattgacacatctatactcccttcatcctattttatttgatattttaacaattttttccattttgattgtgattttacaatattaataaaatattaaattttgcattatatatttaatcatttattgtaaagtgagaaaataaaaaatatacaaataaaaaatctaattaatataaaagacaaagaatatataaaaaataattacatgatatcattcatgaaatttaaaatattaattttttaggtattcagataaagatattatttccttttcgtctcaaactttggcataaatctaagctacgatccaataaaaagaaaaaggatctaatgaaaaatatttttaatcttatataaatgtagaagaattttttaataattgtattttagatataatatttattaatttatagtaatttataaatcggtcaacttgactcatgatgaccacttaatttaagaagtagtctataaatttatttttaatgaagtatgaccatttatgtaatgtcaaccgttcattagttaaaagagaaaacaaattatataggccgacaatggaagtggaagaaagattaattcggtgtaaaataaaaatattaaatatcatttataccataaaaaatttatgcctttcaatcacaaatataatatataataaatttaccgattgaagaattatgttaaaactcatgacaataacttttaatttaattattaaggtgtcaaaaaattacataaaaaaatacatatagatagtttgcttaaacttaaaaaaaaaagtgattttttattaaaaaatactttaaaaaaacttaaacaaacaggtcaaccattatattctaataaaaataccccatcaaggaagaaaatttaacggggtaccggtggagaaaaaatgaataatgattaacgtacgactggtggagaaaagatgaataatgatgaacgtacatatggtttttagacgtctagcgttcaacccaaaaacttggttaattatatgcataaatatgattaattttgttttataaatagtttaaagtaaataaatatgaatatatataatttgagtaaaatttgacaattagtgaaagaaaggtaaaaataggtattatagattttatgatgtaataaaaagagaaagataaaaataaaataagagatattaatgggtgtttaagtatcattacttatgcataattatgttatataattatcattaattttttataaactaataagttattgattctaatagtattaaattttctccctttgaatataagacttcatatttgattcttatgaatacttggtaccaatattgtatgcataaattttttttattaacatacaaggtaaaaaatcaaccactatcaaacattttaataacttatggctctattaaccacaatgtctaaggtgatcaagtgagttaggtggtttaaggttgacaaataatttttcaataatatttattaataaaatattaaacggttaaaatgaagtatttttttatcaatttatattttatattgtcttttatcacaccatccttttttcttgttccttggtccttttcctctctcgttcgctgtgcgtcgttattgtcgacgtcatcactaccttgttttattttcccttcttctttccctctcttcaatttgctgcattcgccatcatctaaaggactgagagaaacttgtagatccataaccatctaaaagtgagagttcaaaccattgacataacgacattaaaaactagagacgagcatcaacaccgtaatttaacaaatatgaagatatcattatcactcaaagcattatgacatccaaaaatagtgagaaaaactagtaaagaaaactaggtcattttcgcaaacatgttaccctctctccctcttcagtcgttctttccacctcccccaaatctggactctcaaaagtgttttgatgtcgttttcgtggaggaagatgagactgacaacgatagtgattccgatggtgagaccagtgagtccttccttgaggttgcagatggtgagaatagaagagaccaatgatgagggatgaataaaaaagcaaaagggatagaattaagtcacaaggattaaattgtaattacataccactataaaaactagtccagcatggatgaggggctaaggtgggtcaccgtcttcctaaaattttattaatataaatttttattatatatatatatatatattaaaaattaaaaaaataatttgacaataaaaaaaggttgtattgtataatatcatatgatacaatattttttaatattacattaaaaaatagaaaaaaatatttttgagattacattgcataatataatagaaatctttaagattatattacataataagataaaatattttttaatattgtattcaaaaataggataaaatatttttaagattgtattgcataatataaaatatctttaaagttgcattgcataatatgatagaatatttgtaggattgcattcaaaaattggttaaaatcatatacttaaattagtataaatagaaacatatttttgtgtttatagtatgcattccattctaaataatattagaactttagagagtttatgtttatctcattgagagaattgttatgagatcatatagaagcattttacaagtctgattcttaactctctatcaggatttaaagatacctatttattatcatagtggagttgtccattggattgattatccaatttggacatcgtattttttattcaattgggttttctacgctaaaactaattgtgtcttctttatcttttatctccatattattgttttgagtttgattttaaattctgaattttttattaagactcattagactttgtttgcttgttcatcaaccccatcttatttgcaatttgtctatatgtaatttgtgaattgtgatttgcctctttttgtatattagatttatattatctttaaaatacttttatttatgatataattttttttatgttcgtcccttcaatgaaattcttatgtccgccaccagcataaaccacattgcttactagtccatcgtacaaggcatcctctattaactacttgttagagaaacttaatcatgattagatattttaataacttaataatcttcactcttaactacttatgatgagaagaaaaaatagccatatttgaacatgtaattaatcatgtgcagcaatctaaaacgaataacattcttaatcacttgtaagataaagtattatataatataagattataaatcacttatctacatttatttattattaactatttgtaacagaagattaatcatacttatacatttgattaagtgtaaaatatgagtggaatgaatataccgagagaagattctggagtccaagattccttgaaacgggcctaacctaaatacctaaatacctaaatacctaaatacctaatctatcgcccattggttacgcccacagcacagcacagtggtccactggtccactagcgtctagcgaggcgaacaaaaaagtgaagccacctctctctttcaattattgtctcttctatcggactctgtttatttttccaccaaggcaattttttttctttccattcattcatttcactccgtacgcattattcacggccacatttaaaccacatctctcttctcttatctataaaacaagaaacaaaggcacctcatcctctcacaccacatccaccaaagcagagctagtttagttagttactcttttctgcatgttggttctctcaacaacgactcctccgccaaaaacagaagcaaaacaagattattcattatttttgttgggttgaatccccgggttgaagcgttgcagacatcacggctattctaagagtctctcgctccctcattcatgtcccaactgtacgacggaggacgggtagttgcgtaacttccgccaacccttcgccgcacggtgggcgtggtgctttgccttctgaaggtggtagcccttcagacttgctcttcctcgctggtggcggtgtcttctagtttcttcactctttttattacttttagcctacatactcttaaataagtaaaaaaaaaaaaaaaaacaacagactttgtgactagttaagatcgccgtttcttcttcttcttcttctactttcgttcacaaaatgatgctcagactcaagagggttcccactgtcgtttccaactaccaaaaagacgacgctgcagaatctcctcgtcctgtcggaggttgtggtcggaattgccttaaagcttgttgcattccaggtacttctttctttttttctttctccaactcatatatgcatgtgcatgtaacattcacggttttttttgtcatcaataactctctaaagttgagttggatccattatacatggctctttttttttttagttatttgtgttttttgctttgttaacagatgcaaagcttcctttgtatgctttcaagaaggctaatggaaaggatttggccctgcatgcatgcgccggagagcctcccctcacattcctcgactcacttcttcttggagaggtagatatggaattttgctcatggagaagggttaacaccatcttttcttgttaccctttgtgttaaagtttctaatttttttttttaccctttcatggcagtgggaagatcgcatgcagaaaggacttttccgctatgatgttaccgcctgtgaaaccaaggtctgttttgttttgtttttgtcttcctatgcatagatatatggatggtatgatttctgagtttgatgtgttttgtggtgattctgttgtaggtgattcctggtgaatatggtttcgttgcccagcttaatgagggtcgtcacctcaagaagagaccaactgagttccgagttgacaaggtccttcaaccctttgatgaaaacaaattcaactttaccaaagttgggcaagaagaggtcctcttccaatttgaagctagcgaggatggacaagtccagttctttccaaatgctccagttgatgttgacaattctcccagctttgttgccatcaatgtatagacactagcttttgttcttgtgggttcattgttaggcgttttatgtaataactgatgatgatgtttgtttgtttatcgattttcttaacaggtcagtcctatcgagtatggacatgttttgctgattccgcacattttcgagtgtttgccccaaaggattgaccgtgagagcttcctccttgcacttcacatggcagtggaagctgataatccatattttcgattgggttacaacagcttgggtgcttttgcaaccattaaccatcttcacttccaggtactggaagctgatcaactataccacttaatagttcgtgttgatgattccgctgtttaattctacaaatctgattgcattttggtgattttggcatgaatatatatgcaggcttattatttggctctgcccttcccaattgagaaggcccccactaagaaaattgcaagtttaaatggtggggtgaagatatctgaactgttgaattatccagttagaggtcttgtcttcgagggtggtgatacgctggaagatttatcaaatgttgtttcagatgcctgtatatgtcttcagaacaacaacatacctttcaatgttcttatctctgactgtggaaagcaagtctatctgttaccacaggtaaactaattcttgaagcaagtgaatttgcctaatctattttcattagttgtgtgggggtatttaccaaatggatgaacagtgttatgcagagaaacaagctcttggagaagtggatgctgagcttcttgacacccaagtgaatcctgctgtgtgggaaattagtgggcacatggttctaaagaggaagaaggattatgatgaggcatctgaaggcaatgcttggaggcttcttgcagaggtgtccctctctcaagagagatttcaagaagtcaatgatcttatttttgaagccattggctgtggtgaattggaggatgtcaatgttcaaagtgtcaaagaagctgatgcagtcagcacaagcgaacaccctactgtggtggtgggttgtgaatgtgtggttctacagtaacaaggctctaacattatgagcaaattcagcaaatccgcagtgctttaagaataattgctgaattgtgtcaccgtttaagtcacatagtagtgtgctgtgcttgagccttaaggtcgtgtgttgtatgtatttgcttttatctgcctttatgacgcgttcatgtgaaagtacgatgtaataactgctcacctgagtactgttgttggtgtttagaggtatgatgtatcataatgcttgacttgactgtgagaaataataaattcagtaatctgtttgtccttgtagtagttcttaaggatgaaatcttcacttgctgtatttctggtttccctttgtagtgaatgttttatgttatgggttaagaatttggcgagaatctttattttatttttattgctgttttttcaatgcctcttggctgtgcattagtgcttgatcgtttttagattttgatagaattgattatgaattgttgattgtttcagattttgttagaattggttgttaatagtttaatatgattaagaatgtgttgtagtacaagaaatggattaatgttgtaaatcatagaggctatcaatagattgtttaatgagttggtcttcaaattgattgcatgatgctgtcaaagtgctatgttgttttagattctgtcatttagttattgtatgttgtcgcttataaaaaagaaatcattacatgcttcaagttgagcatagtccttagacagtgcagaactttttaatttttaatttttaatttttaatttttaatttttaattcatgttaagttggttgcgttttgggacagggcacatactcatctcatgtagggacatctgccactcaaacgctttcagtaattaatgatgtataatgtagcaattaatgatttggtatgtatcttcctcaaaaaaacactgaagtattttaatttaggcttaattacccattgcatcgtcaatttagtagtattcagcaccggttcttgcatcttgagtattcggacagaatatcttcaacacgcacaaagcaaattctggtgatgtacttgtaaagactagcgttctaagtcagtacataaaggatacaaatgggtatttaaaattagagagaataccttatatcctatatgatctatttatattatttcctttttacatatttaactgatgtcatagggaatttgggcaattcttttaattgtttccttttaagctttctaaagcttaaagtttaaaactattttttttcctcttaagatttcataatcataaaataagataaaattaataagtatcaacattcagctgagcacataaggtgttacaatggactacaaacagaattgagtaagcttgaagtcctgaggtgcgtcaataatattataaaaataagcttgaagtgcgtggttggtttcacgttggaatgtctcaaacggccgttgaattaaaagttttgaatttttacttttcacaaaatgtgcatgggaatgtgtgtctgtttaatctaatattaaaccaaatgcactcgaaatcttgagactcgtcaatagtattattaaaactgtccgatcgtcgtcacatgtcgtctggatagctttattttattcactttgctttcttatttggtattctttcttgctttttatttatttttaaatcgtgcaatgcacatgtttttcaatgctaataaatcacaaataacatacggagattcatgaggtagttacaatcttttcagaaaggcatttcaattttcatgtgaatcagttcccttcaataacgtaacagttcatttcatggttttgcattcatcatcatgttttacaatcctaaatcacgcaaccttgttttgaggatcaacatacaaatgttaagcctctcaactcattatgcaaaaagcacagagctagctgacaaaatattccttctagtgtatatgtaactcgaacacatatatagacaacgtccaccgcccataacacgagatcaagaccatggttgttattcatgcaagaaaaacatgcccctttggcttgtaagaaaagcaatttactttcacataaacatgtatgtatgtatgtatatatatacatatatgtatgtatggatgtatatatatatggttccaaaatgctacccttcaagccacttcctcaagatgagtctaagagcacaatcttcagctcttgtaacattggtggtggtgctgttgctgatcaagatagagggaaatccaacaccaaaagaagtccatgagaatggcactgatgcctcatcttcatcaacatcattgatggagaaagatgagaaccaaatcattggatgcaggggaagaccactgatatgtagcagaggagagtttccaccaaggtctatatgctgtggagaccgttgtgtggatgtgactacagacagagaaaattgtgggctttgtggggttaggtgcacgttgaatcgtcaatgctgcaaccgtttgtgcttaaacacaaatgtgaacattttcaactgtggtaggtgtggaagagcatgcccccttgggaggttatgtgtatttggattgtgtgcctttgagcaagcagtgccaacgccaacgccaacgccagtgtcgccatcaccgccggtgtcaccatcaccaccagtatcagtatcaccatcaccattgtttcctcccgtgcctccagcaaagtcaccacagccaatagattaccaacctgaaatggattaagtattgttgtaatagattgtggatggggtctcttggttacctctcccctgctttgaagttcgtatctttgtcattctaaaataagtatttaagcctttattagggttttcatgtgcaactgtttgtgtcaagctgatgttggtatgaattatatgatgttgcagttacatatgatgttggtttgatactttctttgttagtagcaaaacatgttaattttatatgagaaagaacattataccgagtaacttcctggtttttgttggctgacagtggttgaaggaactaaaaggagaagtatttattgtggagaccatacgagtgcgtaaaaaaggtcatggacaacataatctaagagcactggttagcatttgcctcaatagtattattagattaagacattttaaagtacttatatcgatcatttaaatatgtaatataaaaatgacaaattcttacatatgatgtcctctctgaggtcatttataacaaacatgatatgccaatgtctaccagttatggttttgtaattcatgaatgctcgcacatcttcaaatttgaaattatttatattcagtaattgttacataaaaataaaataaatcatttatatgaactacagacacaattagaacaattatgtatgtatattcagttcaattcaattctgagcgttgcacattcatacaaaggacatgcaacatcttcatgttttaagacagttctcctccttcagattttttccttttcaggacattggttatgtgctaactgtgtcttactttccgcttacttgagcttgaccttgggacttctcagtttccactattctctttaaggagtctttgtgatttcgtttttttagctgtttccaggttcttcctcagtaaattaatctctctaatatagtaatgttgtctgtcgatcaccaatccaaggaacagagagaatcctgcccaataattaccattttataggatttaaaactcatgttctgcacataatagtatatcagaagtgctaaagagaaatctatattcattgatacttgatagaattcatttctcaattaaatgcattgtccaagcatgagtaatggcaaaatatgctaacaaaaccggattataaggttggtttggtggtgaaaggaaaaggaaaaggggaagagatcgtaggtttgaatctcttaactaataaaaaattaattattagtaactgacatttgccgataaaaaaaatgtcaaaatatgctaaagctacttttagttagcacatattcaaaactataaatatagcctcttcaaataattaatagagaattttattggtgggcatttctcaattctgtttgccacgagtcaagcctagagaaacatttatttgtaaacttcatagtgaaattttgatgatttcaaccttcttgtcacctttcagagaagttatgaaactaaacagatgcttacactagtacacgtggggtaagtaagttcgctttctgttgtgtgtaacaaaatagtcctgcagatattgtaactttgtaagcaaacaaggaatgtattttttgagtaattacccaagaaagctgcttccaagagacgatgtgccatcaacacctcatcagttggattaacaatgccagcatccttggaacgcttttggattttgattatagtatacacggtggagctcaagaccacacacatagttgctgctacagtttttgtgactaaggtgcccctcccctgcttcaagaggtctagccccatgatcaccaattttcgtattggatttgcaaaagataatattaagatgaatgctatttggatcatcaaaagtatgaataaaagttgtatcatctttgtagaacttcttaaatgttgatttctgtggtggaggtaagatgagagcctggatgaaaaataaactctttattttgactgagtaccatgtgtttataagctgcttttggagacttgtgaggttaggcgaagaattatgccatgctttccgttccaagaccgcagcaggcacagaataactttgaacaagaggaatcagtcccaacacgtttgatgagaataaaactgaatatggcctgcaagcttgagtgatctctaccttcccaattcaattatcaattacctctcttttcactttttcttgagaatataaaaccttgccttgatcatccaagactttttaccctgatttttttgcaatttacacaagcatattatatgcaatatatactagttttagtacctgagcaatacaaaggacgtatgttgaagcttggcaatgttgagaagacaactaacaataattgatatacaattattatttagaatgatagaatgaaaccactcttcatatatttatcaccatgcatctctcgtcaaccatttttcatgttcccagcaaacaaactaatttgcatgttgaattctatgcatatttttttggattaagctcttaattaacaaaaataaataaataaaagcattttttcacatgagaattattaacttatagaggctacattcgatgtggcgtatataaaaacccgggaattctagaaggaatttaattacggcagtgtattattgccaatattatatcatccccgctttcttggaccctatgatgatatgtatctgaaaattttcatccgctaaaaaatagtgtaagaataaagtgccatgaaaagaaatcgtcttattactccaggggcaatccctacagtatagttcatagtcgtttcatacaattttggagccaaaaactgtgaccctcttcatattaaatgagaggaatagtgggtagaaaaaacacaaccatgctgaattaatatcgaagggaaattgggatatgatcctaaagagtttgctcattacagattataaattacgggcagccgcaattcaaaacctaaacaaaagagaacccattatggtatttgaattttgaggtttaatttactccatttaaaattagaggttcagttcatatgtcgagcagaagcctgcgaggatcctccacaatatctttgatgcgtcgcagaaagaacactgcctctcttccatcaataattctgtggtcatatgttagagccacgtacatcaatggtcttgggacaatatttcctccaacaacagttggacggctcactatggaatgcatacccaagattgcagactgccaaaaacaataactgcatgagttttctttctaaataattaatttcatattttattgttcacaataattagcatcattaaaaaaaacaattatacatatttaactagtaagggaatagatcagaatatttggcttgatatttagaattaaactgatccttctgtgaaaacaaattgcatattgaagagttactggtgacaaaaataatgaccattttcattaaatgataaacaatgcctgaacctaccaagatagaaggaaagcaatcaatgattatgtacaatcatatacatacagaaacaacttcaaaacatatcgaagaatgtcttacaaattaaagaaaaaaatataatgatatttatcttagtataacttccaaacctgaggagggttgataataggggtgctcaaaaggcttccataaacaccaccattggatattgtaagagtgcctccagccatctcatcaattgataaagttccatcatttgccttctttgcaaaagcattaatctgcttttctatatcagcaaagttcatggtatcagcattgcggataaccggtacaacaaggccctggaatggcgattgagggtcaatatttgttcaaatacaacatgcatgttgataattttcatggccatgcaaaaaattgcaaaattagactatatactagatcactagtaaattagctccatagccatgacaatagttgacataagttgatcacagagatggctaagtttcatcaagacagtataatgattgattgatttctcaacgtaaacaaagtaaatgagaaaagataaaggtggctgataaaaaccttcggagtaccaacagctatgctgatatctatataatctctgtatataatatcatcaccatcaatgacagcattgacaatcggctgatgttggagtgcattaacagcagcctaacatggagaccataaaaagtgtatgaggaaatcaaaaagggaaaacccagctagtctatacttcagtaattagaaaacatactttgacaaagccagacataagccccaatttgactccatgcttttcaacaaaagcatccttataatcagaacggagcttcatcaaattagtcctatcattaagagcagagcaataaggaagagaatgataatagtaatccactatataaggatatgacaggaaacacaacatcaagaattgacaattaaacacatggaatcactctttttgattaagtctacataataactgaattacattcctccccctccccctccccctccccctcatttaatcaacagaatatcccacgatactgggtgttatcgcatagaaactactcagtggcataatgtaaaattacatagatgagcaaaaagctaagcataaatgcaagaagggaaaaatgcttcaaccccaatacatataagtcaatcgtttccctatcttcttctaaacaaaaaaataagaaatgtacaccaactaagacaagtagaaattgagagaatacgtaacaggtttgttgatctgacaaagaccaagaaaaattaacagaaatgtaatgactctccaatgtatcatagctgtagaggacagaccatgggttgaggacttcattaaatttagacaactgtgttccattagaaccatcaccaaataatgtaatagtgcatttttatacacacatggggtaaaaaaacagtttgagcaatattaaaatcatatgctacaatttgacaatcaacaaaacttacatatcaacttcattgaaggttgtcagcatagcaaacgtgttttgggaatctttcagccgtgtagcaactcgtttccgaagccttgtcataggaacctttgataacaatggaagacattaaaacaactttcatggttgctaaatataattcaggtaggaccaaaaatcaaaatgcctcactcgtctttctctttctttaggaggaagctggggctcggtgggagacttcagaatggcaggagatgctttgggcttctctttagcaggagcagtttcaactttgggagctttcttctcctcgctaaccttttgggttggctgaggagcagctttctcagatgtagtctcagatggggcaacgtgagttgcatcagcagaccttgaaatgattgctatcttgttacctggctcaacagtatcaccttcgttggctagaagctgcaaatcattaaatagatcacacaagccaaatttaataaaagagaaacaagaaagaagagagtaacaatttcttcatttcagggtggttgaggagagtaaaaacaatttaaatctatgaaactgtacctttagaatcacgcctgactcaggacttgaaacatcaattgtcacctaattaaggaataaaaacaaaatacagcattaactatttggaaatcaagaaaattaaatgtttataaccatcaaaatccttcacaaaaatttgcatgttgctttgacatagcaccttatctgtttcaatttgagcaattggctcgtcagcattaaccctgtcaccaggtcctgctcccatataacaaatcaaaacacgacaatcagtcaccaataattcataaattaacaattcaaatagatgacgaaaaaaatatacaggataacatactcttcaaaaattgtgccagagttccatcagagatagattcagccaaaggaggaaccacaacatcaaccgtatctcctttatcacaaatataaattacattagcaatcttaaaaatattaacaatcaaaagccaaaataaaacaggttaattaaacaatgtaaatgccagaaaaatgaatggtacattaatagacgcatcaatagggcaataaggcaatagtgtcacatcaatagctcaccactttctgaagaaaatagacgcccccttgttcgaacggttgcctctggatgaatgaccaccctacaaagcaataaggcaatatcagaacagcatcactgtggataagaaattgtaactattttccattccatccgattattaattaatgatttgtcattattgcacccccgaaactccatgtgaaaatatcatcaacagaatttgatcgagtacaaataaaactatagaagaatacagaaaatgcattagtgtctacttctttttttcttggaaaataaaaatcatttcaaacttgcatctcgggacattcaattcccttaataacaccaataaatttaaatacttggttttttctaagaagatgaccacatgataggaatgtttatgtgcataagctagcattagcaacatacaagaaaaagagtaaaatttgcagctaaataatactgaaaaaggcaaggaaatattagtacaaccaaatttgtcatgactaaaattaaggattcgaatcatttgattggctaaggatttgaaaacaatttcatattctcattttcttactatattttttattaccaatccattttttcctcctgaagtcagtaaacatttctgcattactttatttttgttctaacttctaactatatttaaacaataagattgttgttgaagcttccaaacctaattctaacatttgaaagccttgttggagagcttgatcttaagtttccagactccagctaattttaagcttttgtataactaaaacatgttttcaattgtatttgttattttcaaggaaaagattaaagacaccaaaattctaaaccaagagcacccttacaatctatcctatttctgagccgaacttttttacataaattaaagagaatcctaaagcaatgcttaggactattaaatggtgccacgaacctcataggctttgaattaatccagcttcctgcaacaacaacaaaatttatgatttaaattgcaaaattgcataaatcattcaagtaattaagtcaacagcatctaaaatatttaaaataaaatgtacccaaaattaccaagtgttatatgactgaagttttggacaaatccacatccgcctgaaggaaatgcaatctgttaaacacaataaaacaatagttgtaagaaacttcaaaggatacaaataacatataaattccaaaatctaaccctctataacaaagaccataagtaacagtgggaaaaaaataatgaggtcatcacctgtatgtaggatacagtatcacagaacgataagtgaaaaaatcatgtgtgctaattattacttacaagaaatattttttagagaagagagtgcaaaaaaaataaaaatagataataagattgtcccaagaaatttacattgtgtagtctgtacacaaagcaggcagtctatatatccattagcaattgccatactttgctgatataattgagtaaaaaaaaaaaagtaaacttactctatcacattgaatttgaacaaccatatgttaatcagaccacattttgaacaagattcaaacaacacacaagagaaaaaaggtcataaacagaaatgacgatgaccaattacttttcaaactgttgaaaaatccagaagccatagatgtaggaaatagtttcaacgtcaaaaaagaaaaagttagaaaatgaaatgcaccagattaggaacttgccaccaaggacaaaccagatgagcatcagagtcttttcaggttatgaaagaaattttatcaaaaacaattacaacaattaagcaagattaggaatttgccaccaaggactcgacccaatattttcacattctatttgtccaggtagtacatttaacacatatcccaaagggttaatatgttttagtttctataaatataattcgctcttacacactcaaaataaaatagtctcattttggcggtcccttgtttatggaaataggaaccacatgtgacatttccacaaatgagcgacaaaacgaacaattttattttgaaggactaaaagtgagcactaccttatttgcatatactaacaacatcaccctatctcctaaacataatatttgagtaaccatcagtgttaacagttgagaaccgataaccatcagtttcttataagttataagaagaaaaaacatatcaacagagtatatgcagaaaataaagacaaacacctctttttccgcaatggaagaagctctagcagaaactgatgggccagaccgaatcttctgaactgactgaccaagcaactgaaacaaatgcagaacaggcatcaaacatgacttaaacttaaacttcaatctgtggattaacacaaacacattcaaattgaaaattcatcatgattcataagcgtttagaaaagaccgagctctcacccaaggaaacgggctgccagaagcaacccttcgccttacgacaccaaacatgattacgcagtcagaaatctcttcttcgtccttcggacttcaaacctaatttgacaaataacaaattcaaccaacaaaaccataaaaaaaaaaaatcagactgaacggaaaatgcttgcatagataacgtctcggattcattacgtttctaaacaagaatattaacaacaacaacaacaacaacaacaatacacctattgcgatgtattttcccgattcaaccgttctagacgcagatttgcgaaattgcgctgcgaaaaaaaatagaaaagctaatttctcgggaaacagagacgaacctgaacgccaaacgcagatggaagggtagggttgacgatggaacggagacaaaggagatcgccgcctacagagttctgaagaacaatagtattatattcgctctctataattgaatttcttatgtctaatttccctatcttttcgttactgtcttgaaaatactattttccaggtcaaatatcgcgtgtttcaaattttaaatattataatttttcttcctcacctttggaaaaaaataatattatattatattttcttgattaatatttacatttctctaatttaattgttaaaatgcatttttatcaatcaaatcaatttatgatattttcgaaattagtagtttccaacgtctgaatctttgtattttaattcatatctttttactgataaaataatctgttgctaattaaataaatcaaacctttcttcatttttttatttaaactttgtatttttttatatttccaatcaatcatggaatgttctagttatttgtcagagtacttatgtagataaaaaaatgagttatacaaagttaaatttcattttaatcataattttaaaaataaaactaatgcatctgacttcttggattgaaaaatccattagcggattgtttcgaatatatccaaaaccaaaaaactaataatcaataaacttatcatcaaagaatgtctttatcatttattttataattattataaatcagacacacttaattatgaaatttttaagttataatctattaaaaatatatgtattttatttgtataggtaatagtaattaatttctttaagtcattcttaattgtacagtctcagacctacacaacttccgaatatctctcatccgggtaattcattcatatatccctcccgctggaagcctgctagtagaggtgttcgaggtctggattggatcggttttgaagcaaaaaatcatctgatccaatcccttcgattttgtcatttgatcatccattcggtttgaaatttttttcaaatccgatccaatttttttcggtttggattggattggtttttgattttttaaaaagtctaaaataaaacttatgagacttatttttatcaaactaaggagtatctagcaaaaacaaacaaatttattggacaaaaacaaacaccattttctaattttcattggacaaacatgttcattggacaaaataaggagcaatgtattggatttttggtttttgggctatgatgaggaataagcccaagtaggtaaagggtaaggtaaggtttataattggatcgattttcaccaaccaaaccgaaaaccgatccaatccagtgaaaattttcgatttttttcggttttcgatttttcgattttcggttatttcggttatcgatttttcggttcggtcaccgcggtttgcatcggtttggatcggttgatgaacacccctacttgctaggagtcgctccttgtttgtgacacatctcttgtgcatcgatgatcattcctcacccttgttagcatctaggatgtcacagtttgaacatctaacttctcaatagagagcaaacgattggagaaaatggaagaagctagaagctattcatcttatgagatcatttgataaatttttggaggaataaaggctccaactcactttagaaaaaattgaagttatatatctataacattgcttaaggagtagaacacaaaaatatagatgaaatgaattatgggtgagagctatgctagaagaatttgatcgaaaattaagtctagatattcgtttcatcacctgaaaatcaatttgttgccaggcaaaaccagtttctcatctatccatgatcgttccctgtaatagttttggcactatgtagagtcacaaagtaaccttggatatccatagtggcctcaccgttgtctccatccctattgttcttaggatttggtaggtatcatttgtgccaataaatagtaattgttgttcaacttttttttgttgttgaccatagtgttggtacgaattagttctcatcgaaaacaaagactaacttttatcgggaaccatgagcgcacacaagatgaatattctcctcccaacaatatttattctatacctaaggaccaaccaagattcaaacctagatcacttggttaataacgcaaaccattatcacttatgtcaactgatattcgacttgaaacttcttttgcccgacctttttatttagtatatcattgtaaggtagtcttttagcaccaataagttatatatattagactctgattttttgtctttctttgatatatggtggacttaataataataaaatggtgttttttagtcattactaatttactatgttaaagatacttattttaaataggtgtgttcagtgatagttaaaaatggccaaaaaaatgttagtgaaatttggaacggaagcaaaattgaaatatttaaaaagttgagagtaaaatgcaccaaaatattattagaggcaaaatttgccaaaatataaaagttgagaataaaaattacaattaaaccttaaagttaatcacaattaattttgataagattaatgtaaggctcatttgttttaaattaagaagtgcttttaaaaaatgtgattttttaaaagggaacgacttgcatattaaaaaaatagtttaaacaaacacaccaaaaatcacaaaactacttattttattttaaaattaccaaaaatcaaagaagtcttttgatattcaaaaatatacaaattttgatatattaatttttagaatgaatttcatatgattttttagtagatatataaatactgcattcatcaaacaatctcattcaactcttgaaaaaattgtagactttatttcttatttttcttatcagttgctagacttttctttctttcttcacacttcattctctctcttcgttgaagacaatatatatacatttgtaactttgttcacaaagaatgttattgttctaatgagtttccaattgaaccaatagaaaaatcttcatgttcaacattaacaaataatgacgatcataattttgaacctattgttcaaaccaaagagcaagtaggaaaatatgttaatacataaaggactagtataagaagacatgaaactagaatcaatgaattttaaaaaagaaaaatgattaccatgaagaaaacaatttttaaagaatttatccacaaagagaaggcataaattaagattaaatcacaatttagcatatgaaagtgcctcaaagttggataacattgtcagagtaatatattattatttcaaataattactttacaatgtatttatctaatttaaatttaatttatttgaaaaaagtatggattttacatttcttcaaaatttatcatttcttagtattttttttattgatttttctaattttaaatattttctaaaaactcatgtaatccttttaaattttataaatatataaagtcatttttttagataaaaaattattttaaattcttattatataaataaaaattcaaactacaatttttttattacaagtcttttaaaaaatctattaaatgatgacattcctacctaatcttttaaattttacaagatttttatattagaataatctttgaaaatcttaatccaatacacctaaagagtaaaaaagaggcacttagtatctctatattttttagataataaaataaaatataaaagatggagattaaataaaaatgcaccgtcatcgaattttatatgtaattaatgggttagttctttcatatgcatttaaaatataataatgatagtgtataatgttatttaaagaatatactagtctaaaaaatacgaagacaaatagacatcatcattataatatctataataattataatctttcaaaaatcttaactgaattatattttccaaaaacctttttctacaaatttagttacccaaaaaaaattgtaactaaattaatccccaaatatttaattagtcgttagtcattaaattagtcccttccaaattatattatcaccacttcaatcatccataaaaacaaaaatgttaatattttaaaatttcttttaaagatttaatctgttactaaattaaactttagatttcctttttcacttctttaatcctctataatgaccatggtgatattttagatatttggatcactaatttgatgacatttttttatgaaacactaataatttaagattaattgtgtttgcttcatcaaaatttcaagcttgctgcagaagcaccactatctacgagaagtatggtaaggccagactcgatatgccaataatattgttaatatttggaacaagttttatttataataaaaaataaagtaattatagaatttcattagaatatagtcaagaaagaaatttttgcgctcgatgagaattgagcttcaagacatctcgtaggactaatccatcccacgaagctcaccaacaacacgtgcctttggggggtccaggccccctactactggtcggcaaacggacaacgagctcacgcgtcatttctagcccggattctgacttagagatgttctgtcataatccaatgcacgataacttcgcaccactagcttttcaaccaaacgcgatgaccaattatgcaaatcaacagtgagccaaggagcgatagcctcttttgaccgaaaatagtagaaagaaagaaatactcattgactttggggggacatgtttgttcgtgagataagtgctttgggtatagtctcttggaccctgaacctacgtgcctatgacttcatttctcaagaaatatgcgatgacttaacaaccaacaaatctacctatatacaaaaatcgtaataataagtagtatatgaattgatttgggagaggagaattgagccaaaaaaaaaaaggggtaaaaaactgtaaaatacattctgttgagtaaacatcctagttgatttcatgttagcttgactgctccagtccaggtaaagaagttggctgaaggtttgatttggggggaacacctgcagacgctttagggatcttcgcttttcttctccttgcagagaagctgccatcttctcagggcgaaaatgagttccttccaaaccctgttccggctttctctttaccttctttattaaaacaccgtctgcacccttgacgtgatccaaagaaccacttgaacttcccttagctttttcttgtttaggaccattcaccgaaggattgtgaacccgtgcagcggtgactgcattagaaactgtattgtttactgaagcatgagtatgacaactagagtctgcagctaatcttgctcgcatgggctgttgggaagtaattggactaggatcaaattgaacattctcctttggtcgaggtgccaataagtttttcctcttcattttctcctgatcctaacaataagtaaccagtgagatagaaaacaaaaatcattattctcataagacttaaatatgtttttcatacctgtaatatacttctttttcagtttactacctaaatatttttattattattttactacctgatagtttcaaaattttacttttggtacctacctttaatctaagtccattaggtgataacgtgacactttgttagcctatcatatcaccacttaatcaatgatgtgatactctgttaatttgccatatcatcactcaagggaccgagactaacgacaggtaccaaaagcaaaagtttgaaaatgtcagatagtaaaataaataaaaatatatatttaggtagtaaattgaaatagggatatataaaatcaaaaacatatttaagccttctcacaaatataaaatcctgattgtcatctgtacatacaaaaaacagaaagcaaattctccaattcttctgattcataattcatagttatctatttaaagccataattaaggtaaggatgaagagaaaaattaaaagactcctgtttagtttccaacttagtcatgccacataggtatttgcaggctagaccacaaattactatcgtgaaactcctcttaaattttcaaaactgagaacatgtaaactgtaaaggcttctttgttttaatagagattttagaatattactacaccatcgttatatgctattatttattgcaaaggcataccttatgtctgctgtacagtgctctgcgcctctcttttgacctgcaaattgcacgcttgatcccatggttgtccatgtaaccatttggccataattccgcaagctgaagaggacaatgcacttgaaagtgagaaaaaatatgtttagaaaaagcaaacatattaatttagacaccagaaactgcaatgtatatgcaatacacatagtcacacgcaaaaagtaacacaagcttctgaaataagagaatcattcatgaggactcaaaagaaggaaaaaattgcaataaaaaaatttacatgtgtgaaaaaataattgagaatccttttcttttcaatgtattcaacaaaatagttatcaatcctagatagcaatgcttagcagccaaatctcaagttatagctggatagtgaatagcatgattgctattttaaagattattatacagatatatgatccatcattatgtacataattacatatgctaaacaaatatttaattaatatttcttggcttattcccaactatcaataaaaaatcataggtcttcagaaaaacatacaattaaataaaagcaaaaatgaaggaagaaaaatatctattaagtcagagaatagagatgagaacagagatgggtgttgctgtaaaaatcgccatagatgggaggctccacaggtttggttgtgcagcagaacaaagacagtagagagaagaaaggggttatcaaccacagaaaagaagaggaaacgtaggaaaattgagggttagggttatatacgttttctgaaaatggagggaagtcaattttacacttaaagaaccctcaaaaatgctttttactttaaaggcagaaaaggattttcaccggcttctcagcaaaagaggctacaacagcagtgaagcaaaaacaccccacctatggcagttttgtcacatccgaatgacattctgctctgcacctctgcaattgcaccgcaattgagcactattgataactatggtattgaaaagaaatgatagaagagactttagatagtactaatttagtaattttaacttaaactaggagatatagaaaagaaaataaaatcaaacccaaaggaagaaggtactgaaagtctgaaatttaaaaacaaatatcgagaggaaggcatagaaaatttgaaccacctcagcatacaactttctgatttgcggaccagcattttcatctaacccctggaacaattgcaaataagattcattaagaacaaacttcaaaccgcacaggatctataaaataaatacttaaggttcaaacttctgtacatcaacaaaaaggtcatagagatcacaaatcttgtcttccaatgcagtgtccacactaaaattccttttagttattggtttcccatcaggacgtaattcttgttccccagatgctccagcttgctgctgtagctgaaatgcaggaaaacatgaaaaagcatcccatattaaataaccaaaatcttcattaatcaatcgaaattacagttatttcctgtaaaattacaatcaagatacaacgcaagcatcaggaaatatatcaacaaaactagattgagtttcgtaactacaactaaggaaatccctttccaggtaaaagttatccataagtaaacatgccaaaataaggatttgcatataaaactcaaaattgcattgaatcgatataaagaagcatcgataagaaagagtgaaaataagtatactatgaattataactatagtagggggaatcaaaaagaagctacatgaaccagctaaaacaagcaaaaagtactgaatatttcattttgatatggaatgaaatagaaaatgtaactataataaaccttggattccatagttggggcctgcatcttaatcatctcaataaattctttctttatctgttgaaacctaacatctttctcctgcttcgcagacaaacccatactgatcatattttttaagttactctgtagcaggaagacattgaatgagaagataagtttcaattcaagcataaatggtaattaaaattacctatgtaacgataaatataaatataaattataaacaaagagaaaaatagttgcaaaaattcattgacagcataaacaataaataataggtgggaaattacctttttttgaattggattgtaaaagaacggagttcatggttgagtttgtttgatttttatactgaagaataacttctgaaatataattagagtccacttgacataaaattaattttgtagtgataggaatagagttgtttttgtttgggaaatcaccagcttctactgttagtgttagaagaaaaacatttattatgtaaagagtctatccattaccacaaattagggatttagattgatttttcgtatccatgattgattctttctaccctaatccatgattataaacaaagagcgtgggtatagaacatacgcaagttctactcaccaaggcaacaaagctttacttttcctaaatctatttctatataaaaatgtgaacttgagaaacttgatcaattacaattagtgcatgtttggttcaatttatttgaaggatcattacttatttttgcctgcttcatgagagagtttttaggaaataagctagtatttctcccaaaataatctatactgatcttgcacttagaatcaattcaggaaggccatctgtcactgtggagtcaccaaagtctaaagcaaacaggtccttcattcctgaaggaaaaccagtttttattaaaatggaagtgggcaaacaatcacttaaaaataagaatttcatagactcagacatggcttaggctagggtgggcaaccctcataggtctcccacggtgggagatgattttttcaccgttggatttattatcttttaaatcaaaggtctacatttttctttttcttttttataattgataattatctttcctggtttgcccttgacaccctcgccattttccactgcaaaatctccatttgcagtagcctcacttttcccatcagttcccccttcatccaacccaagatcccctctgccctgttatcgctctcctctccatgaccatctctccctaggctcccaccaccaccgcaatgcgaagcctccaatgctgttgcgctgtcctcgtctggtttcgcaacaactgcctcattactaccaacaacaagccctaccttcctccccgtctactgcttcaaccacgctaactacgctgagtctgcctccaacgctgccacacagccctggttgagtccgtctctgacctgcgccagagactctaggcacacagcttcaatctggtagtgtgcgtggggaagcctgagtcagtgctggtggacttggcgaaggccattgacactggttttctttattgtttatggtgggttgtgatttgttttggttttaggtaattgttttcggtcgtggtttgtaacggtagtttatggtggttgcagtagacattctgccatcctagggcggtttatggtagagatgtcgacagtggcttgtgtcatcgcagcagcggtgaagcaacaagatggagtgagagagaagggggcagggacagattgggaaaaaagaagaaaaaattgaatgctttattttagaagtaataaatctaatggtgaaaaaatcatctaccaccgtgggagacctatgaggattgtccaccctagcttgagccctcagacatatgacattgaaatcaccataaaaagggtaaaggaaaaaaaaaaggaagaaaagagaatcaatctttaagaaggtcacaaaagtaagtcactcagtcaaaccacaatgtgattaggtcacgaatgtattcaaagcctagaatatggtattgttaaatcataacctaatcactaaacaaactacaaattgtacaaaagttcaggatagtggactggacagaaagataggtgatttgagagatgcaataattagtttcaatttttaaattttgtataacttttgggttcaacaacaaaaaggcagcctagtgctatatagctcctgctaagcattggggattataaccggaaactgaaaaatacatactaaaggattatctgttatgtttatcaagcttaaatacctttagtgttctgagctgaatcagatgcccaagaatactcataagacggttaagtaactcctttgatactttcccttggcttgcctgctgcgacaaaaacatatagtcaatattacaatatgataatacaatgttcaaactgagaagaattttgagaaaaaaataatacaaaattgtgcatatatctagaagcatttagcataacaagaaaacaaaatttgccaataccgctaatctagcaactttagcaagtttcagctttatttctctaggcaatctccgtttgacaccctgaggtgtggaatcagcctcctggttttccatagttggtggccttgctgtaataatatttaaaataaaaacttagcattagcaacaaacttcccacattgcctataatgtgagcttcaaaacattttccaaacttacattctgcaactatcttctccaactctcgaatagctttctcaagtgttgtcgttttaggcctagcaatagaaccatctttcttgagcacattttcagatttctgcataagcttcaaacaagatcttgatcaacacagtatatgttaaacacataacagtccactttcacaacttttgttgtcagaagtcatagtaataagaacatgttatctcaccaagtgcacgctaaatggatagtatagtttgccaaaatcttaaagaaaaaccaaccatgtataccaatatcccttaaatagaaattattttgaatgaaaaaggatgacccgcaacagccaaggtaacaagtaaatggagtaaattgaagcaatatgctacactgttaagatccgatcacaaggtatgagacttaatcccacaataatagtccatagtggatggagtcacgggatcactcccaaaaacaatagtgggatgactgctatttttaatatatgtatatataaaatattttttattctttctattatattataatatttaattattacatttttatttacatatattttatttatatatatttatattattattattataataatctataatatatacactacctctgcccctaaatgagacatttttcaagttgtcttttacattttttataccacaatacccttaattgctttacaataaatgcaataaattaataagataaatttattctttctcttacaaggattggagaagactaggacacattaattaattaggtaaaaagtaattaagtggaaagagagatgatgagttaacataattttaagggtaattttgaaaaaataatacaaattgctaaacaaatttaatgttgctaaccaaattaacaaattttcttcaaagatgtgaattagttaaaaaagtcttatatttagggatgaaggtagtaatatataatatgcattatacatttgtctctattatatgatatattatgcattaatttttctatagtttttaaatattatagaatactttatcaaggtgagccctagcacaatggtaaagttgtgcattggtgaccagttggtcatggattcgaattcgaaaacaacctctttccatatacaagaataagattgcgtataatgaccctctcccctaccttcacatagcaaggagcctttgggcactggggtatgttagttttttagtttttattatagaataatttatagtataatatatgattaattataaaaataaaaataaaaggcaaaagaaaacctccacaattgtaggactgcttgggttggagagtagcccggtttagggtgcaaatacaacacccactcccacccaaaaacaaagtaagaaaccttggtgtactttagtttttattatagaataatttatagtaaaaataaaaataatgggcaaaagaaaacctcctcaattgtaagactgcttgggttggagagtagcccaatttagggtgcagatacaacacccactcccacccaaaaacaaagtaagaaatcttggctctcccactacaatagttagctttggtggtgtatttctcttaggattcttatcaattcgcattaaagcttttcaacgtgtctcttaattgcaaacgagcgatgtggatggtgatgacaacattgcagtatttgcttgggactagtcaaagaactagtgcatagccaacctgaatgggcatcggggttgccaagcatggtgagatgataggatccaattgcaaggtatgagacttgagtctcatgttggaagtatgggattctggttttgtgtttataagactttgagctctctaactacaacggctagtttttgtaatatgattttcccaaggttcttatcacacacttttcctggcacactgcatgtcatgcttcaatgtaacctgttaatcacaatggaagttgatctactagaagtgcttatttggtgggcagttccatgcttcatatggtagctatggtttagaatggagaatcctttactttaaagctgaatagcaagaatgaattgatataagtgcagcagcgagccttcttcaacatcaacagcacctttaacccaagttaattggggtcggtggtagatgaacccaatgatagatacgaggaagttaaaaaaaaaaaaaaggaagggggaggagaagataaaggggaaataagacaaaagaaaagaaaaataagataaaataaaagaagggtgaaagaaggaggggggaaacaaagagggtaagtactaaaaagggaccgtatagaacatagaaataaaataaagacaacagaaaagcagctacgtaaacttactggtgtttgtatagcagattttcccacggacaagttaagatctggcagttcattgatgccatttttatctttcgaccgaccagtcttttctagattgtcaacactatttgaggtttttccaggatgggatttggaatgtgcagatccacttttttcatggtacttctgatgagaagtatcaagcaagccacttccatctttatatttatcacatgtgttcttagattgaagtactttggtcttctgtttttcagcaccttctgcagcagcaggagcatcatcatttgatactttcgaacaaacaggaggatctgatgttggtctagtgtcagcagttttcctgttcaaactaattccagacacatctaactcactccgaaatttcatgtcttcataatgttcaccgggtacacccaaattatgggaggaactaattgtatttttcacaggtaatggtgcagtctttccagcagcagtcttgccaacttttacatgtttatttgatacatgactatcaatattttctccaggattcttcggtatatcttttcggcgtcttttctttgcttgctggataggcaatactggaggttcatttctggtaatatagaaagaagaaacagaaaatcaataaaatcaggaatttgtgtgaaaaaattatctactccaaactacaatttaatagattcaaaatgttggcacaacatgtgtaaacaggtgtcacatgaaagaatattcaatcataaaccaagaaaaaatgttatcaggaacaggaagaaagaacttcacaacatcaaatactaataaaggccttaagctataactgatgaaaagtttaagtcaaacaaagtgataggtacagaaaagtaaattcatagtttagaacaatagtgcaatagaccaacaatcagaaatgaaacaagaccaacatttcaagcataaaattaacaagttacaggaacactaatattagtctttgtcactactcaaactatgacagtgaatgatacatgatctcattacatgttcatataacaacacaagcatatatattccactgaaaatgtagtattatatccatcaactgaaaaagaggaaagtgcaaaggcttccaaaattaagtggtttacaaagaaaagagatagacataaagagcacaacctagtgcatgaggctcccacctaggggtgggcatataaactggttcgaaccaaactgtttccgaactgcactggttttttaaccaaaccagtttggttaaataaaactcaattgttttttttttcaaataagtttggttcgaaccaagctggttttaaagccagtttacaattggttcaaaaccaattcagtcctggaactagtttttgaaactagttcggttctgaaccagttttttaaaaccaatttggttctgaactcgttttaaaaatcacttctcaaatttggtttcaaaattgaaaccatttaaaccaatttggtttcaaattcggaatcggtttggtttggtttttttccctgaccagtttttgaacacccctactcccaccaaatgagatttgaggaaggaagatgcacacagacttggccccacaagtgaagaggctatttccaggattcaaactggtgacctccaggccaaaaggcagcagccttagtgttgaacaaaggctagccctcacaaagataagaaattgccatactccgaaaatattcaaacaaaaaacacttacatgcgttccaatttccccctatttacaaagaatccatcatgtttgattgcagaattatcaacctcaaaatactcattctgcagaaagaacagtagaactacataaaaaatatgcaaggtgaaacggcaacaatataggacaatacaattcctgtcatcattaatcaaaggtcaaatggtcataatgtcatgagtcatgacaaattaatatggtataaaaagataccaaccaattcagcatcatcaatgaaagagtcttctgtatcatactgatcatcaggaacatcaggtgcatcctcctcatcactgctgtccttaccctaaaaatgattcagagtcccattattcccaacatggaaaatagctcgaaaaatttaataaaatacttacatatgcatctatgatatgaatttatagtagaaaccaattcatttttgtacagaccattgagtaacaatctcaggaagcaacacacccataccatgtaaaggcgttcaatcttctctattacagcactgaaacggtttgtctgaggtgcatcctgttcttcaatctccttaggttgtccctaaaagtgacaagtgttattaaaatagtgaaaacaaaatcacatagtcacatactatttcgaaagacaatatgctaattcctgctggtatccagatgacaaataattatactgtagcataaaaccagatatagtcaattcaaggctcgattatgccatgccaaaaccagtgttgttttagcgctgacacaattatgccatgccaaaaccagtgttgttaactagcagccaaggcagaatggcaaggtagattttttaccaaccaccataggcaatttgtgaagaaaggcccgccataaggcacaatggtatgtttatggcggaatttcagacttctgccatctgccattgataacactggccaaaacacaaatacaaacagacagacattatatcaataggcataacgcattcaacctaataaatatgaagtcaaatacaagtacttccgcgagcatttcgactttggcacgacaaaaccctattaaatgattatccataagagcagcgccacgcagcacaaaccattgttgaaaaccaacaagaaacatcgtggcataacacgaatccaaattaagtcaataagcataacgcattcaacctaaataaacctaataaatttcaagtcaaatacaagtaattccacaaacaattcaactttgccacgacaaaaccttttcaaataatttcacgtaagatcactgccacggagcacaaaccgttgtcaaaaaccgacaagaaacacccgggcacttcccagttaacaacatgccaggtcaatcattaacattttagcagaacgtaattctaaaaaataacactatcctcattcctaacccttatttcagtccggaaaaaaaaaaaagaaaacacagtcacggctcagtcaaaaaccacctttgcaaattacaattcaaaatatcatccatacaccacagtaaccctctcacacattgcaacctacttaccgaatcacaatgtacgtaaacagaaatttcagaaacacactattactcgaaacaacaatttggaacctaaaaagaggctcaccggagcgattctggacacgagcgcagggttcgcattgggagcgcgatgctccggtgcggaagcggatccattgttgaccttgctggcgtccttcatgagcttcttccacgacactatggtggtctctcccgggcggagctccaccgtgaacattttccggtcgcctttcttcacgaacgaagacggagccctcgccgctgccgacgaggaatcgccgctgccgccgagaggagccacctcctctgcggccatcgattggcgagtttctcgggcgtcggtgcgaggtttcggggaaaaactgttagggcgcgagaaacttggcggaaagcgaaacgaataataataagccctagaaactgaaaaggaagaacagagaacgagaacgaaaagatgaaggagtgaagaggtgaattggaattgcgcggattcaaaaatgagagaaaggaagaaaagagagattttaagtttgagtgcaatttggactcggtcgtaaaaaactgtgttatatggtaattatttagcataagtggattgttgattgtacaattcataatacaagtttgaaaataatttacgtagcaccagttgtttttgttgttgttacgtagggtgtggaagtattctgagtagtagtactttatacttgttttttttatcttgtagcaagaggagatacagcgagtgacacctcctgtttggttgtcatactttttcatgattatatctataattgatgtaatcagttatatttaaaactaatgcaaaaaatatatataatcaatgtaaaaaatcagttataaatataacttgtgtaaaagaatgtgacgtcctatgtgacaaaacaacatgctatgtaaatattttcaaaactacaccaaactaggatgacaattactatgatttagataggttcccataaaactatacacataatcttatttagatataatatctatatccggtctcatattgctccaggtaacaattttaatcatcatttttatacctgcatgatacttatatactcatatttacatttgtgatatacactttacttatatataatatataaggttaataataataaaatcaataaaaatttaattaaaatatttactataattatattaaaattcattattaaataattcaaacataaatatgcacataatattaaaaaaaaaaaacataatattggtttattcaaacttaagtcataaataaataaaaatacaaaaataatcatccatcttagataatcatccagcttaatgatttaggattttttggctacgtgccactataacagtataactatacgcttattcgttcattttttaataggctcgaaataatgataaactagatcttatataaacctgtctagaacatatgaacaaaaatgggaccctacataaaggatgacatgtttactaaaatatccatccactcactcccaaacataagcatatcccaatatcccaagcacaacacagtgacacacatgaacaatatgaggtgcctccacctccaaccttcactgcttccttttcctttgcatgcaaaactcaaaccgcagttacatcatatgagccacactaccaaactattttggcttactactcaccaacctccacgtggccagcacttaccttcagcaagtccactaagtaccaaggcacttccacatttactggttgttgccccagcccaatccggtgacttgtccaccttgcttccaataaggttcaatctctttctttccctttttcattgcttggagaaaagttacttactaatattaccatgtctaaaaaaattattcaataaatttgggagttagaaaagagggtatactaaaaaaaaatgtattgcgagcattcctcctatttatttgatagttcatgattattataattgaatttgacactaggcttaggcttataacaaccttttactccaaaatggagttagtgtgatcttttaagtctagaagttaactaaagatttctttatatattgcagtgctgtgcttctatcggcatacttcatagcaaattttgtcgtgccaggtttccttaccaactctttcggatatgataagccatcaaacgaagagcagaaggttgacgatgtaaatgcaatagaagatgaatagatagtcaagggaggtcacgaaggaagaaacaggattacgtaaatgtgagaactgagctcatgatggttgaagcactactgtacgtgtcttttgtatctttagttcgcatttagattataataaaaacatccaagtgagatttcttttgctcattaatattaggtattctagacttggtagcgattacaatctcatgaaaccaaattgttcctgcccttgatttactggggttactactacccccaaaaaaatgttagtaaacctcttaagagtacagtctttatttaacataggattaatatgattattgtttgatatttaagaatacaagttatttgtactaaagaaatttgccatcaatgattatgtttatgttaatgttagtatagaaatacttgcaagtgcatcatgatcataccattaacgtaaagagttgtatgattcatgaaacatttgttatgacaatattccccccccccccccccccccctattatctctcttcccttcctaactttttccaacaatattcatgtccaaatacaatttctcaaacataaattcactgtgttatacttttatattaatagatcaaattctgttagatagagactaaactacccaaaagcaagcattactataattttttttataattacaagcattactattatatatctattaggatatattttttaatgtctttttttttaattattataattattattttttaccgagaacttaatgtcaaccatgaccgaattcctacagagttgcaagcttgaggagtatctcaaaggatctccaacacccgagcagatagcaagtattggcacagagtgaacacataaaatgtttactaaaggcccgaaagctatattttcaattccctcaaataaaaaagaatgaagtattaattaaaatttctacagaatacaaccactaagtatttggcaaaagaatagagaaaatttacagttatctgcagggggaggaggaacccaaaaacattgcttatcctcaataaacacagtggaagatgaaatttgtctaaacaactgcccaaccagcatcgatagaagatttctcagaaggagatggggatccagacttgggaggcttctttccaaacaaagatgacttgctgtcaaagaaactagagaatgattgccgacctgacttttcttcgtcgtttgtctgatcttttgagacagacttcctcaatagtttatctttgcctccaaagataaggctaagcctcctaaatgggctccttggttcaccagtaaccgtagttgcttcctctgtctgcttaatcatttttagagcttcttcgggattcaataacattttctccactgtttcatatacctacacaggaatacgaacattaaattctctattgaatgatgttattaacaattagttgcagatataaatcaacaaccaagagttttattatcaatttacatttccaggggaatgatttttcatccccatgcttaagaagtagggttatcttgcacaacgagcttgtatgttttttttattttttaaaaaaagaaaacagcaaactgaatagttctggaaggtaggctaggtaaaagttacaaatttcacgcattgtgatagtcttggagtgttcctttttcttcaggactctgctttgtgagtttatttatacagtgaatgactgttcaaatacgaggataaagcaataaatttctccactggattacatgtcatattgaccatgtatttcatggtattaatcaatagagaggcttcacaaggattcagggagatgctatataacttcataagtcacttagtctaggagtacccacctggacgagaccatcaactttctcattcaatttgttgttttgacaagcattagttatgtactccttgcagtcatagaataacttcgagaagtcactgttactagacagcataggttcggcaattgcaaatcctaaaccaagctatataattaaaaccaaaggttatgattagaaaggtatagaaatggtataagcatcaatacatatcaatcaaatcgagtcaacttatacgaagatgaaggaacaggttgagtttttatcaagaaactttacaaaattacaggattatataataggatcatttatcaattaagcaacattttggaacaaaatactttatgtaatttaaaaattctgaaataatataaagttaagaataattatatttcttttcaataaaaattggtaagagcaaatgctttaatcttcacaaaaattaacagcaatgccactgaagtctgtatggaaaggagttttactaaatgcttgttttacattttttattaggaaaaaaggacaaagatgtttaaaaaagtatttagttgacagtacacatcctccagtgaaggctatcaattttcttgaatgacacaggatattactattagtcctatgtaacaggaagaacatcccccatccttacaacaacaaaagccttatccccccttcttcaacagaaaaatattaaaagtaatacatttcatctcctttatacaggcagatgataagtatgtttgcacagtttccatttttttacttccctttctcaagaccaaaatttttgatctaggacacccataaccagacattacattgaagatttgaatactccagtttgagccaggttaaaacacaaaagttgaagaatttatactaacaaatgctttattggtggttggagccagctcaaaacacacaaattgaattacttttagactaacaaatgctttacaagtgttataaatattttttaaataattaacattgatacagattatggataatgaagggcatttttatcagttaagggcagatattttggataaattatgcacttaatgctattggaaatttcataaaaagcatattatgcagttttaaactcttcctggtctactatcaatgctcatttcatttttaactgtatactgattatggattaatgggaatgcccttaacagataaaaatgcccttcatgatccataatccataaggttattgtctacaaatgcccttctctaccatacacacacataacatgttgctgcctacagtcctgaaatccagcatgtgaaactgcaagtgtgcatgtgttaaagaataaccctatgctacctagagtcctttgaaatccagcatacgtaacatgttgctgcattgtatattagagctctagggagattttgggaatggacatgtggaggcgaccaattgccttatatgttcgtataaaattctttcaaccaccagcatagataacaagttgccttatactagagctctaggcaggttttgttaagggatgtgtggacatgcccaaccggcatgccaatctaataattctaaactcgcaaaaaatgcctagagcctagatgtcaatacatttttctcctatgatatgcattacaggaaaatagtttagttcttgattggtaccttcatcttcatgattcaagtctattactatatattctacaatctgctttagattcagccaccaaactccaaaaaataagaaaatacaattttcaaataaaaaattaattaatatacatcacttatgagttataatattaatgcttcagagatccattatgtaatgacaaatgacaactgtctatacacaacaaaattaatcaatgtgataaaagataaaataaagaacttactaaagaaacaaacagctgtccaaaaagatcatatggatggatgtcttcaaatgcattgaggatgccctccctataaatgaatgcaacaagggattcaagggatggctttagggttgaaatatataaattaatgcaaaaaatcttcatcaccaacttacactgccaaatcctcatcaaactgaggtgcctgcttaacagcaggtactggtttggatgtttcccacaattcacgccataaattacctacaaatcagatatgtttaataatatgaaagcagaagaaagtaaatgctcgacagttcccgtatttcttgcagattttgtgtgttataacttattataacttataataaagtaagacagtactcaagatttacttatctccatatgctttaccatagatgtgatatgatatccaatttaggtaatatatcttacatagatgctacaaagattgaggaatagggtttcaacactttcaattccatggtttgcccaaggcaattaggaatatgaaatctgaatatctatgctgatatcaattgactgacaatgaaattattaattcaacattcaaaattattcaaactctacatttagacattctggacccaaaactgatcagtttgccacaaaagttcctacattagactgcaataaacaattcccatcatacatagtgtagttcagtagttccatgcatatcttcctcacaacttaccaaatcacaacctctttggaaatcaaagccataaagaacacataaatgatggtaaaatttataagcatagagcaaaagtttactacaatcgatgacaagttacagtgaataattgtttcaagcaaagtaaatccacaattttatcagatgttgatggtccatttacgtagaaaaataccacaaaatagccttgcaggagaatttaagtacatcaatctatgatggaaaagactgaaagtacaccttctttttgcattcgccgacttagctgacctctggcagacaatgcctcaccactatcaaaaacatcactatcctctgtacttgcttcattatctgtccaatcaggaggagagtgccatcttacaaaatcctccaaaatacatccaggatttgcagcctaaaatatgataacaaacaaaactaactcagacagaacattaggcacattcaacatagtaagaagcattcacaatatcagtaagaaaagttcccttcaagggagctccttaccttgaaagcctgcatatctgagagcagttgagagcacccagcaccaacactgaccatgaaaggtaactttgtaataagaaaatgcctaaatgatgataactttaagctattacataattgatgcacatctgtaattaaagaaagctagcatttacaaattatttacataagaaacagatatgatcataaatgtattacaaaatagcattctgtgaatgtttgttgatcaactagttcatcaatgcaaattctagaaattagtaaaaaaaaaaaaaaaaagaccaaagacataggtcataggttcagaatccagactcagaccctggtcgtgggagttcatagtctagatgtgagtcaataggtcataatcataggtttagatcatgcgaaacaattaaaaaaggcatacaggaacacatctaacaagcaatgaagagcccaagaagcaagatgaccttgattattttaataaagaagttcattatatgaaagagtcaattgggattcacacgctatatatagggaaaacagaaagtccatttagatttaagataacagattgcatcatggatgaatctcagttagcatacagacctccctgtccgcagcacaaactcctctgtttccctgattagatcttctgtaagcaaaggtccttcctacatgaaatggtcccaaagttctcaagtataagagtaattttaaatagtgattatatagaaaaaaaatatatttatcaaacctgagtgattggagaatacacaggctcgccagtttccaacaatgtcatatctccagcaggatgatctgcaccaattcgaagaacaagctccccactattcaatctagcatatagaacagggcttgcaggagctctggcactacaatcagtcgattcttttatgtctgaattagcttgcatcatcatagagtctaaagattcagtggcaataatacggaaccttttccgagagatgcagcaattaattacttgaaattgttgatatagaagacatgacttcagatcaggaatctcattctgggggactcctggtaagtattgttcctcaaaccaaagtttccttagctgtatcagtaaaataactaatcaagtttaaaatattcttcttcagctggtaattaaggaaaagtaggattagtgattctagttaagttcaagttacagatcctaaaccagaagaagtttgtatatgatttttttttttcttttatagacaaacagatttgaggaggaaaagaaaggcaaacaactttacagtgcacgagggattctgttgttttggtttgaaagccttcaaagtttccaataacacagcatatgaataatttgcttccttttccacaaattttattttgcaaaggggaagggaaggataaaattggatgcaaactttaatagaccagaatttaaaaaaagaaaagaaaaaagaagcagcataaaacaaggaaaaaaaattcactacccaactgctcaaacaaaatgaggttctcaaacctttaaaataactattaaaaatcaaaacaagtaggaaacaaaatttgacatttatcaacatggcatcatcaagttatcttgcatatttatttggccaaatcacgtgatctaagatgaagatgtcaatgatgatgatgcactctattactaagatcataatcacttaaactgacagttacttcagataatagtttatatataatggaaaaattgatcaataatgtaaattaaatctagagttctgggtaagtaataagatgtatgattatgatatcagaactataagttcttttgaagttaaacatacttcagcaacaaccccacaccagaaaagagccatttttcgaagagtcttgtagtttccaaggatttcagctagcttaacaacaaggctttcgggaggcgcaccatgaatatctcttggcaaagatgtcatagcactttcctctagattcgagtcgatctttcttctaaggaaatctccttctgcgaatatcttgcaaatattacaacgaaagtgaaagatcataacagataatgggttaaggaaaatgaggacaagcattaaaacgttctttaacataattacattatcagcaagccacctacaattcacatacctggatcaaacagagaattaattaattgcacaactttcttattgctagtaaactcagatgtaagtttgtcctccttttcacgtagcactaaagccttaactgccaagagacttaagcctgccctctctctagcaggtgaagatcctcctgatgaagctataaaatctttcattgactttgctttacttccagccctagtcaagaggtaaaaaaaatttaaggaagaggctagatatattgttgagcagcaatctttctgaatgatagaacaagactcttatgttgttgaactataaaaacttgcatttgacaaatatgtgctgtgccaaatagagaaggggaactttgcaaccagagaaatagaatgcaacatcattgagtagaacctttcagtagttcacaaaaagcggcaggaaaacgggacaacagaatgcaaaaatatatgcaaaacaattacaacttactcaacagctatagccaattgctttagcacagatgatggaggaatggggtctttagttgcagcagttaggccttcaactgagggaattgcttctgaagcctgaatcaaagtttttactcatacatcattaaagcaacccatatgtgtaattgaattggcaaatcaataagatactcatttatataattgataggcaaatcaataagaaatctcaattgtatcttcaaagattttactggaaagagggacaccatgagatacctaataagcatgcattaccaatttatcacaagcataccaagcattgctaacttactagacaaaggatgatgacacaatctgacagactattttgaaaacaaaatgctcatagtcagcatacattatcagcttttgctaacatcctcctcacttaacttcctggtttagagacttcaatcatacgcacacagttggaagatgaatccttgagttaaaatgtttcagattttcttaccttggcctcgagatcattctttacattcaggaggtacaaattatcatcataaaatggaatggccatgcttgcatccccaactttatctgtatcttcaacttcttttctccctctccggatgttctttattttatcttgccaatcctgctttattcctaaatgtggaggcctccactttatatgcttcgattcactatgaagctgcaccatcccattacaaagaccaattgtgtaagtaattacaggacaaatgtcacgtaataaatacctagacataaacgcaaacaaaaacatataaacagttttcgatcatctttaagccaagactcatttcgaaattataactattcactttgcaggactcctgcaaatattttcacaattaattgtgattttttttttttttgaggaagtcattgagggaacgaatccaataagaaaccaaacaatgaatttcaacaccctgatctaaatttcccttcccttattaacgtcaaattagaaactcacgaaacaaatatacttttgtttgataatcaaatacagctcccggaagtgcatatacgttgggaataaaaacaaaaacaaaaatgcaacaaaacaaaacaaaaacaaatcgaacctcggtaggattgaaatagttaaattcaatgtgtcctcttccaaatcaataattgccattaccttggagtcgttttcgtcggtgtgaggagattcagcttctggttgttggccagtgaaggtgttgggcgacgactgcttatcgtgatcttcttcacggtcaacaaattgagtcaatgctaattccgaaaacaataataataataataattatttttattttattttataaatttattttttgtttgaatctccctaaaagagaaagggagaagaaaaaaaaacaaaaaaaatgcacatccgttcggaatataaggagaaaaaggaaaaccaaaaatagagagatagtgattgatgtggcgcgaggagaacctcgatcggatttgaaatccaagagaacgcgctccgctttggccgcggcggaatgaaaggcggttctcgctttggacacaaaagtgtgctgctcctcctccatttcctgcgcacgttaagccacaacacgcgaagatgaggtcaggattgaaacgctgagactcatgccatgccaagactagatggactggaactggaagaagaccaacacggtttcataattgatatcaactagtataagtagtagcggaacatcacaaattcactctcctctgcactcaaataacccaaaccaaaacggggatcgaagtaataatattggtccgttccgttatatactacgagtccgtggcaattgccaactgcattaaatcactctgcccggtcttttaagggtggatttagtagagaaaatgaaaaaaaataaattagtaaattagtatgaattttagacctttattactttttcttcttctttcctttctactaaacccatcctaaattcgttttctcgaaatgcatgccggtctgtcctttcctgcagtccaaacttgtgctaccatacatgataaagaaaaaacaaaacaagcattcacggttgagtagaatggattagattgtctgtatttgggcaataaaattgattttgaatttatatgtttaatgtttaaatatttttattataagatcaatttattatgagtaaaatttaatataaaattttgggtcaaatataaattttgaaaataatccatatattatcacttttaataatgtatcatatatataagggatagtctttatacaccaacccaaaatttaatacatcattcaaaaattttaaatgccaaaagtatccttgtgttaaggttcttacggattcatcgattcgtaagtaagtttttcttttaaaaaaagttaaaatatatatttttaaataataacacatgcaactcttgaacttacaacctccatgttattaatacgatattccaaccaactaagctaataaatcaattatgtttaaaaataattattgttgtttatattaattatccaaccaaccccgtcatgcaggatccctattccaaaaaaattacataattattcttatattaatttttattttatattctaaatattaaaatattaaaggttgattttatattttacttatattagaatttaaaattaatgttttaaattgttggtgagacatttgaagtttttttttttaaaatttacttgtatcaaaatttaaaattaatattttttttaaaattttggagcagactacgaggaccagggtgaacgaacgaacatagtgacagtggaaaaagattgcccatgacgaggatcggggacggagacttaggctttgtttgagagttaggaggggaagagaaagaaagagatttaaggggaagtgagaggaaggaaaaggaggaaaatgagagaaatttttttctccttatttgggagttaaaaatatattaagagagggaaattcagagttaataagatatttttacaattttactcttacttcaaaaattaatacactctatattttacaaataaaacttaattttaaaatgactgaatgataataataattttattatttttccttctaaaaatttcaaattgggagaataataatttttaagctttggaagttttcagaggagttttaaaaatcttcaaatctttttcctcaaaaattaaaactctcaaagaaaaaaatgtcatcacttaaatcttttatttttttctcttcccttttaaaatccatctctcaaacaaagtctcaaattaattggaggacggggatgagcagcgggggagtagtcacccgccttgccccattaacgtctctagttatcctcacatcagtcattattgaagtgacttgtaaaaagattatttaaaaaaaaaaaaattgtgaaaaacaacactaacatacagttatggaaggtttgtataatttggatgagattgtaagttgaaatcttgtcatcataaaaaaccagaaagacaaaaatcaatgaagccatatgtataacaaaaacagagaatgaacagtgacaaaggcagggaacataatagacaaggacagtgaaaacagtgagggaacgcagggaacatagtaaacaaaaacagggaatagagaacagtgacaaaggcaaaacctgagactgggaaaatcagagagatgaacatgcagagcctgaggtgaaagtccagtcgccagcaagttgctgaagaaggaaccgtaaattgccagaggaaaccgccggaagatgctgggctttttagatatcccttttctgatttctcggagacaacaaaagtgtcctttacaaaacgccctggaccaccatgttgatgttgtcatgatcctgcagccaccatttgccaccacaaggaatcctcaactccaagtgtcccacacagtgatttgctggatttctgccacgccttggcagggtggcactgccctgctgccattgtggctgtttaacaacacttattcatatttattttttcattgcaatttgtttttggaatgttaaacaatactggatattttattattgcacaatgcatatctttctactgtaggatatttaatgtgtatctttggagaaaaacccgatgaaaccactctggagcaacttgtagattgggaatacacagtatgttgccgtttgcacttggtcaagtgatttacataattaatgttatattctgatggtagtcatttcaattacagttttgtgatacagatggagagacaaaaaaaatacttttatagaacgccaaagacacgagaattggacagtctgctgggagatatccaccataaaattctaggtattttaagcatacatttgatagttccctattgttatttatttatttactttgaagtaagtagctgagcctttgcccagacttgtaacatgctctaaccttgaaatggaaaaactccacttaaaatccagttgaatgccaatccatgactttggtttagtcatgttgaggtacattggaaagcgggataatggagaaacaggcacactctataaagatgcaatattacgtgtagagttgtaagaaattagagtttaataaaaaaatatgaaattccttgacacagcttatgtgttataagagctatgtgatgtaggtagttattttcttcctaaattcaaattataacacttggtctctggtgcaaatcttacttatttgcgaattcttttattcaagatatggagagggcgatcaccagagacttgttttcacgtatatttttgttccaaacccatttgataaaggtggcaacttttgcagctgaactggactggtaagataaattttgtcattataataactggtgcttgctcagacatttttttatcattgataattttatttcagctttttgtcaatggccactgattttttattcaacggctacaagatctacaattccgtgagcttgggcttctgttgctgacataaaaacatccctttccatgtcttcggatataacccataaaggtttgccttgagtcgggcggaaaaaaaaggggggtatgttgactgaagaaaatttgcttgatataaaaaatggaaggttcaaaccatcaagtttataagaacctcttggaaatggagaatcattgatatggttaatgataaaaactggttttgtttggaggcatgttttgcaggaaatgactgtagacacatttattcctaatgacactaagattcttcatgatggtaaatagatgtagacatacataactgataattgctaacttatatcattgaaatccattttgatgacattatattgttattaatccctgttccgttgttctttacattaggaagaattaatatcatcactggtcctaatttttctggaaaaagtatctatctaaagcaggtcagttattagttctttatctttctggtatatgtattctgtatgattttgatcatactgttttaaatagcaattatgttgaaaaggtcattctatgacattaccttctagtctccaaaaagaatgtttctaaattctagtctctaaatgaaaaaagtgttgcagaactattctttagcagtacgtgtaccacgttatcaacttctggttgttaatattcatctggtctgacaacctacaaactacaattgataatatttatctggtctgtcttgatttgggttttgcatgtttttattttttgatattcactcgtaacaattttttctgttatccaattgaaaaagaatttaattaccatgtatttttgggataaaaattactttatattattattatttaataacatattattatattatttgataaatacaagaatatatcaaatttactacatgacaattggcatcacaatttaataataatataaatttattgtactcaatattaaagtaaacaatttttaatatttcttatattatcttgtttttgtatgattacctgacggtaaaatgacagactataaataaattaaaaatcttaacatttttattgttttatgtgatgagctcttgtttatccacctttccagcgcaaaggatttttgtgagggactgtcttgaagactaaaaattattaacttccacattaaagttcatcagattgttgattccttaacatacagtctaatgtgtggctattacatgatgctacaaccttgctccttgttgctctatgatcataatgtaatgagaagtattttgcaggttgctataattgtttttctctcccacattggcagttttgtgccagctgatgcagcaactgtgggtctgacagataggtatcattttcttatgaatcgtgtcctttgtgaaatgggagttacattgttgtatgctgatcttagttttacaattgtaattttttttttcctttggtggggagggggggaatattttctgcaacaggaagccggcttatgacagctgaacaatcaacatttatgattgatctacatcaaatagggatgatgctcaggtataccaagataaaggcaaataaggatatcttcaatacattgactatatatcgatcataggcaaaatctgtataatctcccagtatttggactatcatgcaggatgctcctgtcttccatattactcacttatttggtttaattaatcatttggtctctatatccatgccaacctttcgtttaagtccctatacctaaaaactttacatttagtccctatacaaggaatttttttaagttttagtcttatgcctccattttgtgacggttttacactaccagaaaacgaacaacatgaattaaaacataaaaaacttgttcgaatagggactaaaacagagaattttttatacggacaatttttaggtagagactaaaatgaaaagttgatgcatgtataaagatcaaataattaattaaacccacttgttttataattgcagatgtttttctgaatggttttatctgaacaattaaatagatgtagggttccaggagatttgtagtttattaaaagaagagtgtgtgtataactgtatatgtgtgtgtgtgtgggttgggtgtgttaattttttcttttaatgttgaggaaacctgcaggcatgctacttcacgttctctgtgtctggtggatgaatttggtaaaggcactcttacagaaggtctgttaatccaatgtttattaagtgtctaaatcataaatacatggaatgtgtgtgtactgcagatgctagtttttaccataaatgttttgatcttcctttgaaaatgatgtgtgtggtttttggaatcctgcagggctgcactgtgcactgcttgctggtaatttacaaaactgctgtttaaaaatgaaaagagtacactacgcatattgttctttctttccttttagctgataacaaaaatgtataaagcatattttatgttctgctcttatttattttattagaacaagctgtacggttcatgcaggtgtaccagaggaaatcataaaaagagcaacagctgtgttggataccgtttcaaataataaacatgttgagcggttatgcaatgagaacatctctgcttaagatcgtcaatacaaggtgtcatatcaattttcaagaaccaaattacagctttggatattgtttactctctcagagacatgttaaattatatttctgaatggaatgcaggatgccatggagaaattgttggaatatgatattgacaaaggcgacttaaaacttttctttgaggatgtattttctctagttcttaatgcatcgtgactgaactgaagtcttctgctggttgttttcgtaggaattattgagatgccatatgtgatcatgacatttatgtcaagacgagttgaatccatgttttattttaagtcttttacaaacttaaggtccattttggtaaatagtttaattagagacttacagaataatatttattatgtataagttgtttttatattgaagagaaaattaagttgaagttcatttcatattattttgaagaatttattgaaataaaaaaataaaaagaacttatgaacatatcataataagttcaaataaatttaaaataagtttcttgtaagtggttctttatattgctaaattatcaagcatcctagttactattagtttcctcgaagatttctctttgcatactgacccaaccgttgcgacatctactttagggtggataccacctgggttaggttggatcaaagttaatgttgatgctgctgttagaatgtctgataacgaggctgtttgcggaggagttctgcgtgatcattatggtgtctttttgcatggttttatggcaaacattggaacttgttatgtcctagaagccaaactttgggctatcctcaatggccttcagctagctttggatagaggttactcgcacgtcttagtggaatcagatgcggctgaacctgttcgtctctgctctactttgtctcttattagagcctgtttggatacaaggttagaagtaattttgagagtttttctactgaaaaaaacactatatttccattagagaagttcttaaaaacacttctaacttgtatccaaacagacccttggtcatcctcttctcgagagagtgcaaaccattcagaggatgtccagaattcccgtgggttgctgtttcagaagcgtgtttagagaacacaaccgggttgctgatgagatggctaagagagttttctctcttcagctttgttttctgcttttaatgttgctcctgcgtttatttcctctttgctgcgtgttgatgcagctggtctgtctgttccttagtttctgctttcttgggctttagccccttttatccagcaaaaaaataaatatattatcaagcaactttaaaatgatttaaacattaactcgtttttctcagctaaaaatccacaattaattgttgcccttgctcataatattttttagaaaattctaataattttgattattaatatgttttaccaccgtttctctttcctttccttctttcggtttgtcacagcttggattcacatcaactcttgaccttgaatcagttggatcttgtcaccttatcaacataagttatcagttatcactatagctacttggtcagataacataaatgatagtgttgttgatcatttcatcggtgcaattaaacgagtaataaaaaacaacaactttcttacacgaatgcatcttgtcatggatacaccttcatctcatgttatgccaaattgccaatcttagtatatatcatctacttcaagtaaaataatacacttggctagccagtgatcacttttcatgaagcctaaatagattactctacggggtaacaaatctagtagtatttttttcgtcccaacaccacacacttggcatttgatattgagttagataaaaaaaatgtcattgaagggataaaatcaatcgtcaacttcagttaggcagctactagctgtctcatattaatgggagatgtgtaagttgaagggccatcaaaaagtttattaacaaatagacgagcagctgcctccgtaggatggaattggtcaaagaagatgtgatcttgtctgttaggacaaaggtttgacaatggcaggcagggagctctggcattcagctctcccagtccacaacaagcaccttttacctcactaaatcctgaaagtgatttaaacttattttaattagaatccaactttataaaaacaaaagagtaaatagccaatttatttcctgaatttctatcttactatcattttagtcttgaaattaagaaaaacttaaataagtctttgaaataaacctatttttttttcttttcattttggtctctagtatgggtaacttaagtgatactactaataacaacataattttagaaacaaaaatgagaattttttttttagagacccaagtgaaacattaaaaacactcacgaacttatttgagtttttctttacttttaggattaaaactataacgaaatgcaaatttagagaataaatattggtcatttactcaaaacaaaactaataaacatggtttggtagaggaaagaaatatggaagaaagaaataaaagagaaaaaaagtgaataaatttttaagttgtttgaattaaaaggataaaaaaataaaagagaaggaagtttcttaataaagaaacgaaaagaaagaaaataatatttggatatgttattgtataaaaatagtaccgtaggaagctggagtctgaataaggtcgttgatggcagcaaaagtgtcaaaataggagtagattatgcttccattctccgattgccattccttcaacatggactgaaggccttcattatattttaccgccatgtcattggcttctataaagcattccgttttgttcttcagcctgaaatcagggcagcatccaagtgtcccaactcccgcaatctcaaatttgcgagcaccatgatcgtataatcgctgcaaaaaaaataaaaaataaaaaataaaaaaagttaccgaaaaaaaaagaagacaaagtaaatgacacacgagttgaccctctaagcacaatagaacatttacgagaaagtaacatgcatgcaaatagggtgcatgtattggaaccccggcccgcaatataattattaagtcaacggtacaatttttttgaagtttgatgtgatgggtaggtaaaagtaaagcaagtctatctattgatcagtgattaatgaagatttgtagcatagtaacttgattataatcatgttcatgtgatgttatgtgttacctgtagttgcacttttagtgagaaagccatggaatccacatactgttgcggggtgcttttcttacgaagatccgatgattcaaagtatccaaatatatcattgctgccaatcaccacaacgaagattgattttgagagatgcttctgtagaccagctgctcctcctacttctcgagtcatttcctcatgcacaattgagtagtagtccacttgtttcctcaacggtattgattgtctcttaaatgatatataataatatatattgttattaagtacactattatgccaacaatatatagaataaggggtggctcagttgggagagtaacgatttttatggaacattatatatagagagggaattcacttaatttaagagtagaattacttttctgttgattttcttaaaatctaataattaagattatgaataatgaaaataaagaataactctaaaagagttagttttaaagtaagtgaattcctcctttatatatatatatatatatatatatatataatatgatgagtaataataaaggtataccttaatttggggtttattagagccaaaaaagaaaaagaaaaaaaaaatagaaagggtagatagagaaaataataattacaataaataattaatgaataaagaaaataggattaaaatgatataaagaagaaagtgaatatatatgatcattcatttttaataatgtgcctaaggggcttttggtagatgaaaaatatttatttttgaaggaatcttaaagtgacaaattgtgatttttatgtttggaatgtaattaataaaaaagtttgtcaagaaattatgatttctgaaaatcaattttaactcattttttcgcaaaaaacattcccaatgaggggtaggaatacaactaatttcttgattagaggaaaacttttaattacttattttacatgaatctttaattttcaggaaacatattaaaactaactaaacgtattttacacatttctaagaattatgattcctagcaatcgactttcctaaaaattatgtaccacccgttgggttggattagttatgcatgtgacctggtgtgtttcaatctgactcggcatgacttgttctcgaatcagtgactcgaacttgacgtgtcatgcatattttagttttttttcccaatcgaacaacatcacttatattagaaaatttaatttataccttacatttgtattatttataaatttgcttatatttttttaccaagcataaccgcatgttaaaatttgagtgataaaattattaccatttttaaattttccttgactaatttgtgtgtattaaattctaatttaaggttgtttatatatattgaattatgaaaaaaatatgttacatgctcaaaattttaaataaattcataactatatttttaaatataataaattttattaaattttaaatcttaaatgtacaagcttacatgttatgaaattattttaatttttttaaaatataaatcggatcatgcaagtaaacagataactcattagatcaatatctaacttagtaactaaatatcgaatgagttaataattagtccgaatctaataacattggttgagaggtgatccaaaacatccaggctcatcttgggtcagattcctatatccctatttaatttggcccatatattgcataaacagaataaataaataaataaatttaaaaaaagcctggaggtaataaaaaattaaagggaaagagggaactacatttggtcacttacataacgttcgtctgtaccatcaaatattccagcacctgcagaggcaaagctaacaccatccatgaacgatgcattgtttttgttggcctttgatgttataagggacaggtaaggtggtgaagttggcaaacccaatttctcagctgcaacccacacaatcattctattaaaaaatgtctctatattctatacaactgtttgaagtggcatattaatagctagagtgaatttggattcacttaccaacaaaatctgcagcattcttgccgttgctaaatctcccagttggtttgtgtgtaggaaaatcaacaccatagtgacgatgatttgccttagcaatggaaagagtcaagtaattgttgttgcccacgtcaacaagtgagtctccaaacacataaacggcagaaaccatttcagcctttgaggaaccaaagctgaataagacgaagaaggcatggacaataaggaaagctcttttacccatcttggtgggtttgtttgtgtgtgctccaaattgtttttggtttagggtgtctttggaggtagacaactgttagatgattgatatttaaagataccacaaagctggatgaaaggtacacgttacgtgtgaaaagataaatttgattgaatgctagtgagagatagtggagcaaagagtattttccagatactccatccacttattttattgtcaatatgatgtgtcatatgttaatgggacaaacattgtcaacatcaaaagtaaaattcttaaacttgttgccttggtttttagtgttaattccctcaacaactaaactgtgacaaagttaagtaggcctgtttttgataattacccaactagctaggcacaactctaactcttaattaaatttagttagtttaatttataattaatctgatcgatgttgctgattaatgaaccttcgaaggcacagatcaatacatcatacatgcatcacgtggcaccctatatctaattgaatgaccaaaaaaatatttttagtggtagatcttaaattaggattttagaccactttttagtggaccctatagtaccacataggattatagatttctcaaaatttctctaattttttcctttaatggtagatctcattttcagatcttagggaaagagaaagagagagaaaatttattcttttttgaacaatgtgcagatcttgagggatcttttacaagaactcattctccatattggagatctctccatttcctttattgggagatcttgtgaagatcagatcttgagtttaagatctttacttaagatctaccactaaagatgctctgatgaacttcgaaaataattactatatagtatatgttgctcaactgttctttatgatttaataaagtagatgggttgtatataaagctagcagaggtagccacatcaaaatacgcaacatccgacaagtaaaagcctcattcagctcaaagtaaaaggttctatatatatatatatatatatatatatatatatatatatatatacacttttatataaataattaatgctttgaacttaaagcttttaaagctaggtcaaaccctcatgttcataaagtgtacagtagtacacgtttaaggtccacagtggtccccccaatattttggctttgaaagcactgctgaatatatattacataagaatttcaatttttcatgatcacacaataccaccttgacccaatggaagtcagcttgtaacatatatgcttcatcccactataaatcactccccaaattcaatccggcattcatgcatatatataaattttgatgagctaaaatagacttgtgattcgaattcattgcacttttgccgccccatatattctttccacttctctatgttcatatcatgattttgttactatagtagaaattctaaggaaacgaggagcttaataaagttcctttcattccaattcatctttgtgtggcatttgataaaagacactgaagacagttttctgaacccaaatctttttaagccagaacttcgacaatatcagaatctttggttggattaataaaatttaatagatacagaaaaatatattgaaataagtaactttattaaaaattattcttaaaataatttgatctatcttgaaatgtgtgtatatgtgcgtgcatgtgagagataatttaatttatgtaaacatctatttctaactaatatggtttaatcattttcctacgtcataagtcttatgatgtaacaataaaatcaatattcaatagatgccagtgtaaaaataacaatatataaattaaaccctctcactctgtgtatatattccacagacctccattccatgatccctttacaatttaaggagagaaaaaaaacaccattctctgacattcaaggggaaaaaatatagtaagtgatatgtgatttattcgtcttcacatgttgtaaatccgttcaaataaaatattacattttaggagcttcactaacaatttgacagagaaataattaatatttattggacgcaaaaggactagcatttagcaagaagggtacaatattcacacatagacacactttttaaagcttttttttttttggtccaaatagaaactattgcttattttcttaaaaatatttaattatgtgcaacttttaaaaaaattattcaattgaaaatatttaaggaaacacaaacaaacagtacattgagttcgtgaaaagaatcgatagggcaacccatcataatgttccacaaccacacaagagaccatgaccgtcccgacgtacgcatttacggtggctccgctcaagttacgttttgttttcagactctttcaagttttcaacgtcacacacaacatacatcatttccccacactttgaaacttaacatttttttttcttagacccctttatttatataatcatttctttggtttacaaaaaaaaaaaaaaaactttatatataccacttaaaagcccgtttatctaaataggaacaactttttttctttaatccgattttttttttttttgccgccagttattaaaaaagtaatctctcaaggtattataaatctacttatggacttgacatcttctaacacatgtttttcttgtaagcaccagtctaaaattaaaccctaatcacatatttaaatgttaaccatgtcacactacatgcacacaactatttttcgaagttcatgtagctttgtacgttcatcatctaggctttcaagaagaatacactacaatttttcctacttaacaggttctagtaaggcttaagtagtaacccgccaaaaaactaacgagtagagacatatacttacggtcaatcacacgactcacggttaactattacattgtacatactcgtacaaatatacgtactactattatattgacattttggcgttctttaattctgtgcctgcttcttgaatcatgattgagatttgagacaaatatatatatgaggacatagattacaaactcggctgaagtttcgaaatgagaaaggaataatctatgaaataaaaggatgtcatacattcatacaatgaatccatgtagttagacagagattggacagtttaaattttaagtttgatataaaatataacttgtttaaccattcacgattgtgattgattgaatatgtcaaattcttgactgtaggaaatccgaatctgaaataaaaattagaaagaggtcacaaagatttggacaagtacccttacgggagtacatcatcaagcatgaaaaccaaaagtgagattattttaactcaattacaaggcacttgtttaagtgttttttgtttttttttttttttaagaaatcaaaatataagagtgaaaatatgtttacttaaaatttaaaaaatattttcaaaaactgacctaaaactgaaaacaacaaatcaatattttctacatttttttaaagaagtgaaaatttaatgatatcttaaaatagttttttcttgatatatgttttttaaatcttgaaaatttgaaaatgaaaataaaaaataaacactcaaaaccaagtacattttagttgtcttaaatttaagttttaaatatgtacttatatttgtgcaaaaaatagaattatgtagttgtattaaatattctgatattttaaaaaaatgatacacaaaaatatttcttaattcttgaattgctcttgatgattttatcccaatcccaatttcctgattaataatgcatttgtggggaattaagtgattatgaaggttgttgagggagagggagagtttgtgattaatatagaggtgtttggttgttccataagaagaaggaagcttgatcgatgggttgcaccgacagctccctctcaccaacgctgcaacagcagctccccagcggatgaggattgggatgaggattgggtttgtgttggaagtagaggagatggacttttatgggtttgaaaaaaaatgacattaattaatagtgttagaggaggccaaagtaatgtaaaatgagagagaaaatgcatgtgaaatttgagtaaaattcaaggaaagttcaataatttgctcttaataaaattcacaagtagtttgattgcattagttgtggaacaaagaaatataattaatattcggaggccaacactatgagacttgtcaaacaaaagtttttttttttaagtgaaaaacaagagtttgcctatcaatatataaatagacaataaattatttttgttactaactaacttaatgaataattgataatgtttataaaaaaatacaggtatatcagaataaaacaaaataaaaagtttcacaaaaatattgagttattattatgaacttgttttcgtggttgatttttgtattgtgtgttgtaggtaaaattccttatagtcacttattttaatatttatgtgatttacatgagaaataaaaagtctgaaagctttgagacaaaaaaaataataaaaaagaaaaaacaaaagcctgtaatcaaaagaacatgcatgtcgagttaaaaaggagaatcaataacttgtatgcaacccctttttaaagcttgcaaatatacatgcataatttaaatttggattaaatatcttttgttattgcaatttaatgtatttctttaattttttgccttgtattttttaaaattttaattcttacaaattatgcttattttattttgtatctttaaagtaatttatataactctttgaacagtaaaaaatattatctaaaccacttaaaaatgaaaaaaaaaatcataatttataaggatcgaaaacatttttttaacggcaacaaaaaaaatgctaaattaacattactaaaaaatgatttaaacctttaaattttaaaacacatatcaaagcgttaccctacggaatttattaaaaagacttaaaaaagtattattcaatgaattgaagggaataagatattcatcaagattatgtattcctatttaaatcctggaaagagagacaaaaattaagtaaagtcaattaatagatgcaaaagttggacaaaggagtactaactcactccaatttcatgaacctaataatcatcacaaaatagattaagaaaatcatcataaactttcctttaaaattctccattgtaataactaaaaaatctgcattactataggagtattttattccctcactctagtacagtagtcattaatccaatttgtcatattaattaattaattaacttttaagttgaggtgagatttacttgctgtaagaggtgatagttggtgaaaataagggggaaatgacaaaaagatgcgaacaacaggcatagaggcatgcgagggacggtttcgggcacgggcagcagatgccgtcattcccagcctgtcacgcggtttcacacacacaaaataagaaaacgtttattggtattaattgtatttactagtttattcattattaattatagtaataaaggaagaaagagaaagaaatgaaagaaataggaaaaattagacactcaaagtcacgcaacttacctcactcatcgtaatccgaagctgaggtccgagtggtaacaatcaggctcgagcctcactgagcttctcgaaaaaagccaatgcaatagtcattaatccaatttgtcatgttaattaattttaagttgaggtgggatttacatgcctcaagaggtgatagttggtgaaaaaataaggagaaaatgacaaagagatatgggtaacaggcaaagaggtatgcaaaggagggttcaagccatgagtagcaaaagatgtcgtcattcctagccagtaacgccatttcacacacaaaataagaaaacatttattgatattaattgtctttactagtttattcattattaattatagtaataaaggaagaaagagaaagaaatgaaataaatagggaaaactagacactaaagtcacgcaacttacctcacccatcgtaatctgaagctgaggttcgagtggtgacagtcaggctcggacctcactgagcttctcgagaaaagccaatgcagtagtcattaatccaatttgtcatgttaattaattaattaattaatttttaagttgaggtgggatttacatgctgcaagaggtgatagttggtgaaaataaggaggaaatgacaaagatatgggcagcaggcaaaaaggtatgcaaaggagggttcaggccatgagtagcaaaagatgtcgtcattcctagccagtaacgccatttcacacacacaaaataagaaaaaatttattgaaattaattgtatttactagtttatttattattaattgtagtaataaaggaagaaagagaaagaaatgaaggaaatagtgggaactagacactcaaagtcatgcagcttacctcacccaccctaatccaaagctgaggtccgagtggtgacagctaggttaggacctcacatgcaccattgaaaataatggagcctcccaaagcaaaccaagagagagaaactcaaatagggttttagggagagatataaagagagtgagagtaagaatgcaacaacaacaacaacaacaacaaatgatggatcagatcgtaacgaagaagaagagggggcgtccctccaaggcagatctggcttgccgttccgacaaatctttggccacctcgcaaccagacctccgacggagtcttcgtcgccgtcggaatgtgtgctacaacattgactacctcaacgaggaggacgaggaccaggaagaggacgagaagaggcacaagaagaagttaaagctcattgtgaagctcaacaacaatgaagaagacaatgatgaggatgactatgagccgagtcgcaaaggggagcgtggggtgcacgcatcatatgaaaagggggaagaagaagaagaagaaaaagggaatgaggaagcgaatgagtatgaagaagagcgtgaggtaacgaaacaaagtgttgaaaatttgagacaatgtctacctcatttttttggtaccaattggtccataattgaattatgtttactatctctctctttgtgtcgggaatttgggggaaataagtaactaacgggtcaactataaaaaactaacacatacatccagactctctggttgtgtttgcttccattttattaacccccatctctctctatgactataaattagataacctaggacccattgttgtttgtctctgtctctgtctccattgcatatttttattacataaacacaatatttgccttttttttttggttttgggttatgttatttattttgtgtgtatgggtttcttgtgataggtaaagggcataaaagtggattctaaagggctttactctattccaggtttgtgtgtgtgttttgttgttttggttgtaatgtaattcgtaattcttaattacataatttcttactttttttaaaaaaatgtaccatgttggatactgaaacaggtgtgccattgtttcttttattgcattgttctcttgagtttcttaactaggttctttattttgtttttgtttctagtgttaggaactccatcaaagcttccaccttggatttcgttgcctgacaagaggaccttggagtttatccttgacaagcttcaaaagtaaggcgattttgtttcccattttctttcttcatgcattcctgttggttttaattgtggtgaatgatttgtataacatcttcaatcttcaacttttattgttgcatggcgatgccatgtcttttggtgaattgacaggaaagatacatatggtgtgtatgcggagccagtggatccgaaagaggtatgagggcttttcttcctgttaattgttaatcttgcttttggaaggcaatctaagatgaaagttcaaattatgtttgaatgcagcttcctgattatcacaaagtgattgagcatccgatggactttgccacagtgaggaagaagttggcaaatggatcttattctaccttggaacaatttgaggtgtgtaaatgtgtcagttgttactgttgaagttggggatgttccttttcttttctgagattttggttatttttgcaatatgattatgtgggttgtgagcaagaggttgttgcatgctatttatgtgaggggaaacatttaaatggcttacttgtcagtataatagagtttgtcaagatttattcacttatgttgataatggaattgtgtaggcaatagtgatttggatgtttttgattgaaactagtggggaacttttgcgggagtatactatttataggaatcatatgaaatttagcataagttatatgtaccttgtttttttcccttgaggagtatgattttcgaaccttgtgcatttttttatcaacaaataaacgatttcattgatcaaagagatataagatataccataagtaaataatctaaagaaaagaaacatccaagtggctatctagttggttatgtcatatttggacgaatgattacccaatatttcataaccaactttcagtttctgtaaaacttatccccttgctcgagaaaaatctctcaaacacctttcctatatgatcatcccaaacatgcatacacattgctagcccattgttgtaatgagtatgagagtttagtgggtggatgtttcaaccatgtccaacttacatatatgacctcctataggattttctttgaattaaaaatgccattgttgaagatcatgttattacgggatctccatgtacaccacaacaatgcacaccatataaagactcattttgttgttgcctccttcaaagaaataaccactccactgttgagatatccttccacttataacatagtacccaccaccactgagcccttggactgagaaataacaaatgttcaattgacttcaatttctctaagcaaatagggcatgatgcttcttcctttactatatagccacacatctctttttaacaggttgggccttgttggtaatctgtccaacatggcctccatatcatcactacaactttcggtggtaaattggtgttccatataaatctccatatgtcatctgattggtcattgccattgtctacctgcaatgatttgtaggtagactttgttgaatatattccttttgcctcaataggccattcccacctgtctggttggtctctttgcatcgacatcgaattcaagttttgatataattgttctagagagggtttctcctaatcaaagcactctctatgccactcgaacgtccactcccaaacctcacccccatcttccaacacttgcaacaatcctatcttgttggttagaaatatggaagagcctaggatacttattagctaatgactcacgacctaaccatgtatccctctaaaatctagtatttttcctatctcccaccctccatctcactatactatcaaaccaattacctttcttcccacccctacacccttttttaatgttcctccaccaaatcgaatattctcttaaagaattatcattgagtaaatattttcatgctctgtaatttgactccatcacattgctccacaacatgcctttttggtggtataacttgcacctccattttgctagtaatgctacattaaaagtaccaaggtaccttacccccaaacctcctttatttttatctctacatatctcatcccatttcacttaagatattttcctatcaccttcccctccatcccaaaggaaccttctttgtatggacatattttttttcaatacaccacatgggatcttaaataaggaaaagaagtaaagcggtaatgatgaaaaaacaaaattaattaagcacactctatctgtcattgagaggatcttatggctccacccactagtttcttctcatacttttccacaataggtctccaagtcgcttgtcttcttggattagcgccaattgacatgtcgaggtacacaaggaactctcaagaacctacaattcaagatatccgcaaatctctccacttcaactcttggcaagcctaaagctccaaagcaactcatggaaaaattgactttcaagcctgatactaactcaagatctcaagatgctcttgatgtcaattacattgttcaattttgtttctcccaaaaacaataggttgacctccaccttgtctttaccaattagagacccatttttaaagcttccatcatcaatcaattcaacccttatgccactacaagaaagagaaatggttccattggatccctttgtcaaagacccctttgcatcttgaaccacttgtatatccgcaaaccttgtgcattaaagcagctgctgaatatccgcaatccattcaaacgttgtgcattaggctaccccttattatcatctgaaccatttttaaaccgtacatagtatattgtcttcctgatttagtgattttgaaaggcaaataaatgatttgaatgcaactgttgaatgcagagtgatgtatttttgatttcctcaaatgcaatgcaatacaatgtggcggagaccatataccacaaacaggtataaaattgactgctttcccttgaaaaattaacgcaagtagcaattttgttgtgcttgctgtatgatccctatatatttgttacaggcacgatcaatacaagaactagcaaggaaaaagtttgaaaagttaaggattgattctgaacgttctcaaagtgagctgaagtctgaacaaaaaaggagatctaattcccttgttaagaagctagaaaagaggccgctgggtcatgcttcacaggaacctgttggctttgattttacctcaggtgcaactcgtgctactattggtgatgtactgccaacttcccttccaatgcaaggtgttgtatgtgaaaggcctggcaatattgatgcccttctggaggggaatgctttattgattgatgcaaatcaagagaaagcagaaaactatatatcaggtatcacagaagaaatgtctatttcatgctatgatacacagaaacaatactgtatcggatacaatgatacgattattttaaaaatatatataatacattacgtgtaagatacatatataaaattcataaacatgataaatatataattataattttgcaaactaaattataagcatacttcttgaacattagtaaaaaaaattattgtacaaattctgaattgatgagaaacttgcattccatttaatttaattgaaattcccttacatgtctctaatgaaaaataaaattataaatgattgcatgtcattataaattactttctattattttgaatataggaacaatactatgaatcttattcctttcttaaaatcatacataaagagaacaatttttatttttggttcattaagggaaagtgtttctatattatacacgcttacatgtttcttgtagttgtattggactttcataaaatgctttaaaagcttggatacttcaccactaagtatatcggtaaagtatagaaagagtatcgatattagatatgtgaagcaaattaaactattaattgttggtgctttatagatttggatacttcttcggtatgtatcgatgaagtattttagagtattggtatcggatatggatacgtgaaacaaattgaagtatatgtgcttcatagatttcatgccttcgttgttcaactttgcatactctcagttggatattactgtcattatctagctgttcgcttttgactgttactttattgtttcagggagggatctgctctccaagttggaaaggaaaccatctgtgcaagataatatgtctaatctaccagctactagatcggattccatatttacaacatttgagggtgaagttaagccacggctagttagtgtatgtatcaaaaggagtgaattgttatttctaatccttgaatagtttagctttcttgtttaaagcattaatgttgtatttttcggcaccaggttggaccacaagatgaatattcatatgccaggagtttggctcgttttgctgcaactctgggacctactgcatggaaagttgcttcccagaagattcagcaggcactgccatctggctgtaaatttggtcgtggttgggttggagagtatgaaccacttccaaccccagtattaatgcttaataatcatgcccagccacaacctagtttagcgactaagttgcagtctactactgaattaatagaggttgaaacaaattgtaagaatgtggaatccaccatggaacaatattctgttaatggaccaatggatgagggaaaacagccttcagcttgttctagtagtgggcttacatcagatgaaaaatcatccttgtttggttctaatgaaccaagacccaattctcatgtcaatctcttttatcagcagctcaatgtccaaaccaggaacctcaacaattatgagaacaagggtttgaaacaagtggaattcaactctttaccctcgagtgatcagaataatgcaagtctagttgcaaagcttacaagtaataatacagctgcagcagtgtatgagcccaaagaaatggtaccaagtaacatgaatattggttcccaatctcctgtgtcacctgcaaaacaatcatctggtgtgctggttgactctcagcaaccagaccggcaactatgacatggaattattgtatttctgatgtggatgcttccacaggaatattgactggttgtggaatttcatccaaaaaccttcttgcatgcataaaaaaaaaaaattgttttccttgtgctacttttagaacagatgaaatgaataccatgtgcttgggaagattgttttcccttggatgcttatgttgggaatcttatgatggttttcttaagtaggatttgtgatcgccacagaagacttgagcagatttggcagaaaacaacttcaagactttccatcttttccagatgagaactaccgagttaatgcagcatgtctgtgttctatcctagagttgaaaccatataaaacatttaggagtcgttcatgatcaagcgttacttagatttttcaattagcgggcaataaatcctgttgatgatgctttctacattctttacaaatggttgaaattcggttgccttgatattgatttcattatgattacttgtttatctgaattgatggggaaggcatcacttgtttttagttcttaatgctgctatatttttctgtacatgtctcgaatgcaaaacctcaacttgcttttccttgtttaattttacccgactctgctagttcaacatttaagtaaaatacggtacaccccttcggaactagtgttttgggtgtttcgggtgtaaatttgtttctaggttgacataaatattatggaggttggagtagcttgtgattattagaagtatcaaactatggaaatatgaaggttgaagtggcttatgattaaaaaaagttgttcgaagattgatgcatttatttgaaacaaactaaacataaaaatggttaaattatgttcctcagttctcataaatgactttatttagttttaattttctttggaaatacgaaggttgaaatgacttatgattaattttttttttttctaagtctcatgcatttatttgaaatgagctcaatattaagatggtttaaaattatgtttcttaattagttctcataaatgactctatttcattttttattttctatttttttaaagattctaaaattgttttagttattgtaaattttaacattttcaaaatacttttatcactattttagtgacaatgtgacattaatttgttgcattacatattatctcataattattgatgctagatgatttatatctatgtcatagttaaaaaataatatgaacaaatcttaaaaaaattaaaattgataagaattaaaattaacaatttatttgaaagattaagaccaaatgaagttatttataaagattaataacttaaatcatatgaaatttgatgagtttagcttatttaaaaatacgatctaatgcggctcacgagaaacaggctcacacttgtatgtaacatgtttggttggaattacataatgtggttattcacatatattggaagatgattgacttaaatcattttttaataatttttagtcacttttaaggatagcaaagagttgtcttagacaaggatttataaaacctgattataatatattttttaaacctaaaatccgagtctaacctatttatataatatagatattttaaatatctgacctaatcttttaaaattttgacctagaaatcctaattagtaaaatctcctttgtaataaaaccttttaaagtagcttagaatcttccctttaaataatctaatgaacttaaaattatatgtaaattaattagtttaagtttttaattaaatatattagcaagacttaaaaaaaacatacaaacaagaataaaatatcaaaattaaatatcacgcacagtgaaatgttaatataattataattatgattcaaatacacagatttattatgtctgaaagattttttaaatgatttaagatttaattttttgaactaaataaaccttaaattaaaacaatagtctaacttgtttaacagatagacttaagctacgtttgtttgtttaatatggatttggcgagaagttacccattagttcattgcgttacttattcccatacccttgtctcactctcacccctaaagtggaacttagggcttttgaaagtaattgaataaataatagctttgtcaaccgcggatttggtcagttgcatgtccctgacggtcttgatgctctgaaggagctgatttgcaagcagggaattctaatccccatcataatgtggtttatttggtgtgctaggaatccagcatttgagatgattgagagtctgtttagatataaggttagaagtctttttgagagcttctctactgaaaaaaaaaaattatatttctaataaaaaattaaagttttcaaaagaacttttaacttatatctaaacaaatcctaaacttcctgctttaaggtctcagcattggttttgggaagcaaatcaatgcacgaatcagcttcagctgttgcatgaagctcctcagactcagatgttaaaggatagtcttatggtggatgctttggggattaagtttcctagaataatgatttaggcttgttggttgttttttgttttccttttttctcgtttgtaaacaaaaaaaaaaaagtcagtttagctctctctgtcagggcattttggagtgatgaaaatgctcatgtgtaactactctatcttcatttttggcattttcaaatcctttgtaacattaatgtacattaccaactgtttctgtgacataaatacagaagaaaaatctttgatgagtatttatgatgcaataggaagaaagataaaaataaatgagataccggatgaacatttaaaatagctagatggatatatatattcactcacacaagaagcattacttaatcaagtagaaaagtcgaacagaattttccaaactcttatattgattcaatacatatactaaagagcttttaagctacaaaatcaacccgtatctttaaagtatacttcacaaggatcacaaacagggtagcatatgagagatctataagttgttaattaataactgaacattaaaaataaaagttaaaatatctttaagaatttaagattactagaggtagaatttataaatgatatagaataagctacgccgttgtacaacagatgaaagcgatcaaagaatcaaatatgaaaccaataaaacgtaaccctgtagtgttgatgggctgatggcatcatgcagaacctgagcctctctctctccattcacaagagtgatatatatatatatatatatatatatatatatatatatatctaacaactagaagaccttttggcacgacgagcaaacgaaatccgaaggctatgtcttgatttcttgctgttagataatgtctgtggtttccccatgtttgccttcgggtttttcagaacacaaacattcccatcgcatgtgtatcttttggattcttctggtgagccctcggagaagcacccgaagatgtttgagaggtacatagctattgagaataataactaatgatcagaaatatacaatacaaatttactctcaaacgattatgtgatgccaccccgttgtgtatatatagttctggtaattgcggccactataattaatgtatggtcaaggttggcttgccgcttcaaaaatatcttttccttatttgtttatcaatatttagggtcacgcgttgccttcattcagagaaactctcacattatatggtcaaatggtttattagtatcaaaacgtgttagattattggttgcttaattttccgcgtgttcacatcttccattttaaattgcttgctttctagaactgctagtattttttttatcatatacagcttggtgcacacacacacacatatatatatatatatatatttatatttatatatatatatatatataggagtaggaactctgcgtgacgtcgtatatatgataacaaacactgctagctgaaaagggcaatgttaacaactgaatatacttgtctaggaaataaaagtaagaaaaaattaatatttattatattgaaacataaaaatcatataaagtactccttcattaatttaaggataatggttccggagtcttcattaattttttttcagaagaaaaaaaaaacaaatgtaagatatgttttagcaacaaacacaatatgttttcgttaatgacggtaaaacaaatctgtcaaaattcgaaagaaaaaaagaaaaaaagacaaatatttgcatgccgacgactagtcaccttgcaaggggtcaaagcacgtggattgcaaacaacaaaaacaactcaactaacccatggtatgatacatcgacatcgtcaaaattgagttaaaaagacaaaagctaatgtatataggtattgggaactccaaatttaagaaatgaagttttacccactctgatcaacaggtatcgttgttcgctgaacagtgcacccgtcatattttcaattgaactagctagtattcaaatcttcatcttcagtattactggataatgatgaccataattttttgagtctattgttcaaatgcaagagtagggataagaagatgataatacataaaggactagtatagttttagatatgtgaagaatatgaagttagaattaatcagctactaaaagattattaaaaaattgtattgtttttactttgtttaatctaaacattaacatttcttgattagtttttttcacgactcttgtgattttaaatgttttctaaaaatatatgaaatcctttcaaatcttataaatacataatattatatgccatcttttaaattcttattatataaattcaataaaatttaaactataaaatcttgattataaaagtctttcttttatatcaaaataatatttttaaatctaggccaacaaacctaaatagaaaacaaatgtatcaagcttttattaatgttaatattaataattttatgcatatattaaatatatatatatatattatgaataagccaatctattaagtttaataagctatttttaaagtttaagtcttatctttttaattagaaaaactttttaaaaaagtctaagtcaaacctttttaataaataaatcagattaagccttgagccctttctacctctacttatgacttgttatggttggccaccaagtattaagcatgtactatatgcgtggtccataaaatatattacactatatgtatggtccgtaaaatatattgttaaataataaatttattttacaatagtaacaacgaacttaagtccattagagactcccaaacaacaaatttatcataggttcatgaaaactaatgaacgtttctgacaaattaagagacctaggttcatgattttagatacctatttacattctcctcaattctctattcaattaaaccccaattattcattttaattactaatcatgaaatattattttaaattaaggtaattaaattaaacacattcctcccaaaatattattttaaataattaagtgaatcaaataaattatgaaattttcaaatatctttaatttcacgaaatctattaaacataaaaaatacaaacaaattcaaaaactcttagccttttaaataatttattgagtagaataagtataaaaaacatgaataatttcaaaaactttttaagtgtgagggagatactttgatgtttaattatgcacaactttgtgaatacatgtgtgataaaattgttctatttattgcaaaaaaactacaattttttttattaatttgatatatagactttgaaatatattagttgataattgatatataattaaattatacttgaaaaattaattcaaatttttacttgacaaaaaatataataaaataaaattttaatttatattaatataatatagactttgaaatatattaattcataatttatataattaaattatacttaaaaattaattcaattttttgtttgacataattgcattagtaaattttaatagaagtagaaaataaataagtgtttacttgaataatatgatttttttaaagaattaaaattttataaaaattagtttaaaaaaatgttttcaaaaagaaaattttgaatgaatattaatgtgatatataatatatagaaattaaaattataaaatattaatttctctagataagttatacttaaaaagcaatattgatagaagaatttgatggtctgacattataaaataattttacagtattctttaattacaaatcaagttggaatgactttcaaaataattattataaaaaattaaaatttatcgtacatgataataagatatgatttaatgatattataaaagaaatttatgtaattgactattaaactattttattcatcatatatcctatgtaaaataaaaaagatattgggataaaaaaataataatttagttgaatggagcattaacaaatatattaagtataaaattcaaatacaatgttattaaaaaaaaaattccattcaagatgaaggaaaatttaaatgtatattaatacaatatttagaattagaaatatactaattttgactttatataattaaattatacttgacatgttgatagaatatttaatattattaatatagcatttatataaatattaaaacaaatacattttattatatactacgacacaattttggtatttaattataatatataaaatttattttataaaatacatttaaaaaaaagtcaaatggatattaattatcaagataagttgcttttattagaagtcaccacttagcttgatctccaacccggccaggtctcttacctccaccattgcgtcgtggccacaatgcccctacccttgttcggcaagtggaatgctttatggtctatagtcatacttattttcactaatatattttttactgcaatttcactaatattattaagacttatatttctttttttaataataagtactaagataaacacatttaaaaatttacatattaataaaagatatattatgttaaaaaaataaaacaataataaattaattccccgtgcattgcatggacttacatactagtaaaataaaaattagaacatcaaataaaaataattttggtattgtttcttcttttttttcctaatcttcttcctaatttttgggaaagctaaatatatataaactaaaaaaataaatctacaaaattttgttcttcacaataattttttttaccaacataaaaatatgccaaaaatattttataaagtatattagtaatattaattttttataagaaaaagtctaatcacgtttacaaacaatattataaaaaatacataatttaaattataaaaacgagcacataattcaaataaatcaattatttcttaaacacgttatgccttgaacaatatttgattacacattgagaaattttttcttaattttaaatttttatttataatttttgcttttaaaattattaattgttattataattatagtgtgattttaattttaaacttttgataattacagtaatatttatcaatcttaattaaaattgtattcttaaatcttaaaagtaaaattataaatccaataacaacaaaatcttatgattgattaaaattaacgtgttttatttgttttgaataaagttattattgaaaataaaatactctataactttacatcaccaaaacatatatattattttgaaatttaaattatattttctaaattcgaattacaatcttgtaaatatttcaatttcaatgcaattcaacaaaaaaattaggtagaagattataaaaaatatatatataaatataattttgcttgaaaatttcgcatcatttactaatcattggtctttaagaagacttattctcagaatacctttatatactgcggatgatttgatagtattccaattttttcgctttgattttttaaattattatatttttattagttgtaaaatttgttaggtttgtgtatactcatatataggtacagagagagagagtagagaaatgaaacctctaatatgcaacgtagatacataacaatggcaaatgaggaaaagaattcgggaggagctgtaaaaaaagaaggtgattcggttgatatatttttgaggaagggtatccgtgcctggcttacactggaacaacaaaagaatcctcacttattttcattcctccaggatgacgacactgagattttgaatagcatcctcagaagacaagaccaaagaaagagagaagaagaaagaaagagagaagaagaaggcacgtccacgaaaggtgctagcaatagcagtgctaataataatgttggagattccaagaattacaaggccatgtgaagatattaaagattcaagaaatgaagggatgtgaggtgaagtttgttggaactagctctccctagatctctgaatatctacaagcacttcagtttatctttgatccaaaaaataaactctatgcatttgtctttaagttcaaacaataactctgttgcataacaatgttatatatcctttagttgtttatgtaacaaattaaactgactcgtacttcacttatccatcaataaattcagatcattcttttcttctatatggtatcacaacctaattgcctgtgtatagggtaccactgtctgccctcctaaatccatcaccatcaatggttccggaactgatcgagaatccaaattattttttaatgttctattcaagtaaattattttttttaatctgaataatatgttattaatttcataaaatatatcttataaacaaacaacaccgtcaccactgcgttcgccacaattcccctccccttgttcagtggaatgctttgtggatgctattgccgaagacaattaccctgtgctgcatgccagattagtgaaggcatcaaaggtccttgcatacgtttatcaatccatcacgatgataatgaatcatatttatctcaaatacttgttagatttcgttgcaatcaattaatcatgatgataattaattataagttttattagtgattaataataaaggttttaaattgcaattgcaatagttgaaattttttaaattctttgtataattcaatatgatgaaagttgctttgtcatttgtgactatggtaggtaactgggcatgttttccagccgatggtgacaccagatgttgagatatatatgcatgccatataaaatattcaaggaatggagacttaagtattgctttgctaatctctttataaacggggagcttattgtgtcctccacctctgctcaaaagtatcttgcaaaagttcaaagtttcaaaggatgccttaaataaaattggatgttctatcccctcggttaatatgaagtctcccatcaatatggagctaacaatatacaccaatgagggtggtaccttggctgttgaagatgccaaaaaaaaaaaaaaaaacacttcatgattattatttagatagcagtacaacttggtatgtgaaatcacgaggcctattgattactttgatcatatgttcgtgaaattgagagagctaggttgccttatttgtaaaatgtatcaatatatcaaaaaacaattaataaaagagatttcaaagttacttcaatttgttgcaaacaaatgaatctacctagaccttgaaaacatattaacttattggaaagcatcccctgatattaagtaaaatatgtagacatgtaatccatatataaagaaactcaaataaaagttacatttataaataataacaatgtacgtaaattatatcaattaaaaacaatttggatcgataaacaaatttatgtattttgtactgttcaatttaattatagtcaaacgctaggctgaaggaagagataattaacaggaactagaccaaaagataatgatataagaattaaaaaattattatttaatcataagacaaatttatcaaacatatatgtattcacgaatttgtatatcattaaacatcaaagtatctcagcacacatttgtccttgtcataataactataaaatcttgttacacacatacaatatcaaatgtttaagtggaccaaacaaaacattttatttttttcttatctcaaaaaagtcaactttgcttcaaagaactaatgcttactgggcaagaaaaatgtctcacacatgcaagtaaatagccttggagttaacttattaacattagtaatgaagatcaattcgagggatatatatctattttttatgattttgttatgaactaaaatgataataaattataaatttttttagtacttggatgtgtaaatttttttatagtcaaacactagtaataaagatcaattcgagggatctaacttgatttttttatgattgtgtaaattttccgttttacacaatgattagagattgttgggtgtgtagtttgaaatctattgctcccatgctattaatattattgaatgtattaaatgtattaagtagtaataaaattaaagtagatttatttttgttttgtaaggattaatttaatgattatgtatttttctttgaatttttattttgaataaaatattgttacaagataaagattaaattatattttagataaatagttatttttgtttcatataatattgataaattcatctatgaatatcttaattaatcttttcataacgaacgaaaataattatttatccaaatattattaaaattcaattcaatctaatacttttttttcaaattttattgtttactatttgcagtccttattaaattgattcagttatcaatatgtcaattttttttcccgtccaaaaaaaataactgaatttttttattagacagagactacatctagactcatggatatatatatatatagaggtatagagagagagtagagtaaggaaaacttctctaatctgcaacgtagatacataacaatggcaaatgaggaaaagaattcaggaggagctgtaaagaaagaaggtgattcgattgataagatactgaggaagggtatccgtgcctggcttacacaggaacaacaaaagaatcctcatttattttcgttcctcgaggatgacgacactgagattttgaaaagcatccacagaagacaagaagaaagaaagagagaagaagaaagaaagagcgaagaagaaggcacgtccacgaaaggtgctagcagtaacagtgatgaattgccaagtccatttaaagaaaagattcaagaaatgaagggatgtgaggtgaagttgctgatacagaagaaactttctgagtcagacttgaatccaaacctaaacgatgccagcttctctatgaaaattgccaacaattttctgacacaaaaggaggagtcctttctagaggaaaacgaaaggatttctggcatgcacgtcattgtgttggatccttctcttagagagtgcaacatgtgtttcaagaagggttcaagaagctgcttctacgacttgaccaatggatgggacagaattgtgcttcagaatgatctcaaactgcatgatatgcttcaggtttggtccttcagagtctcctctcttctctggtttgcacttgtcaagctgtgaacgaagatgccgtacatgtgatgtgatggtctgttatttcaatcttgataattactgtaaaagatctatgaatgatcaccctcaaaatcctctatgtcaatttagaagggtctgaagatattattcacttccaacactttcaagaaataataaaataccaattttctttgcttgtacatttatccttcatttactgcgttttcatttgtgtctttgttcccttatttctctttataaactagaaactcttattgcacccttttgattattcgcttgtcaaaatttctagtaaggttattaaagcatacaaatgtttttttgcatgtgtcatgcattgaactcttaagcagtatagtcctttgcagtgctaagagagggtggaaatggcatgggtaaaagcaaggaaatgaattatgtgtaaaaggtagtagtttatattatgtatgaatgattatttctattaattagaagctcactaagttctcctctaaagagggtgtctcctacgagcatttggagtttattggagactccacctctcaatcacaccatcaccaacaacctttatcgcacttaccctgatctccaaccaggccaactctctcttctacgtgctgtcaacactagcactgtgatatgtttgcgttgttcagatagcaacagtatccttcattcacatgacgggatgaaaaatctcgaaaaaatgatgccgagaacactattgcttccttgatgcttgtggccttaaaggagcataatcatctgtgagtgagaatgacgtgttattaaggtgtctcccatctcctgttattattgggtattgtttaattaaagagtagtgcaactcggtatatcaaatcacacggcctatttgattactctagtcatttgaaattgtaagagctaggttgtcttatttgtaaaatgtatcaaagtaactaataaaagagatttcaaagttactttaatttgttgcaaataaatgaacatgcctagaccttgaaaacatacatttaacttattggagaggatctcttgatatcatgtaaagtatgttggcatgtaattgatatggagaaactctaattaaaataatttggatcgatgaagaaatttaagtattttgtaatatttgatttaattataatcaaaagataggctgaaagaagagataattaacataaatttggcgaaagaaaataatcagtgttataaaaattgatccggtcattgtctaagttgaggtagtaggtcaataggtcagtggtccaaccggtggacaagtaattggtccggtttgacccaatctatattaaaaaaattaaaattatattatatatgtatataactaacattatttgattaagaaaagttcattcataatttcatactcaaaaatccaaaataacaataagccaattcgaaatgcaaaataaaaattgtagaaaataataaacgggatacaagaagcaacatctagtcaagcccatctaaaaaaaactaatctctcaatatatatatatatatatatatatatatatataatcttctcattttggcttgctgcagcgcccccgtccaccaattttttcttcctgcttctcccttgcaccaaattcttctcttcgatcatctctacatttggaggttgttctctctctccctccacgacgatttcctccgattcgtcgccatcgacgttgctccgtccgaagtcattctcacttcctccatcaccactctgcaccgcgtcgcatccacacacgctagtaacaacggagatggcgtgccctgctgcagtgagcgtgagtgcctgaggccttgaactaagccgtgaacaaatgaagaatttaagatgaagaaaagttgaagcttttttttgggttttatgcgtctgaagcattttttcctggggcatcaaaacgacgccattttgtgcgtctgaagcttttttttttcttcaccaaccccgtctgggtcctaaaaaccggcaaggtttttggttcttcccaaaacggttttctctgggccacacgcatggccgattcattagccaactcagcccaattgatgctaggttcccgattcaaccgctccaactggccgattcgaaccaattttaatatcattgaaaataatgttagatttcataaattattatttaatcatatataagacaattttatcatacatgcatgtattcagggatttgtgcatattaaaacatcaaagtatctcccacacattttcctttgtcataataactataaaatcttgttaacacatgcgattaagtgttaagtagaccaaatgtacaaaaaacattgtattaaagtttttttcttatctcaaaaggggcaaccttgcatcaaagaactaatgagtacgaggcaagagaaatgactcacacatgcaagtaaatagccttggttcttgtttatattcttttcttttctaatcttaaaattaaagtgattcttgaagggcaggcaacgcattatttcatatatattagcacatatataacaacttattttgtttgaacttatagtggtcttataaatttagaattgttaaactgatactcttaattaaaaattaaaatcagataaaaatagcttaaaacatggtccatgaaagcacaacatgtagtaaaatatataacaactctcagactattcttggattttcaatcatacagagagaaaatgaccaaatattccaaactcaaactccttagttatttcataaacgcagccataggttcaatttcataatacaagaaaggtggtagtggtagttggttagaaaccatgaatgaggaagtgagaaacgttcttgcgctgatcaccttggagttggataatcttgccaagctccttgtcatgcacaacattgccattgcagcaaaactctttcttgaggtctttgaggatcttctcgtagctgaactctttcttcagcccttgcactgtggtcagactcttcttcccattcctctgttgtatgcggatatgcacatactcttttgccccgggggcatctgtttcttttgcctccgcaaatgggtcgaaagtgctcgtagggatgtgataaatacccacttcaaccatatatatatatatatatatatatatgaaattttcaagataattttttgaagtgattgatcatccacctttataataaggaaaaatatttttagaaaaatagaaagtgcttgtagggatgtgataaatacccacttcaaccatatatatatatatatatatgaaattttcaagataattttttgaagtgattgatcatctaccttcataataaggaaaaatatttttagaaaaataaatatactattttaagttttaatatatatatatatatatatatatatatataataaataggccagcctgatatacctaacatgttttttttttaagtttgagcctgacctttttatttaagcagacttttcaaaaagccttaacttaatttttatagtaaataagtcaggtcagcccttaaataggtcaagtcaaaggtccctgatagacggcctgactcactttcacctctatctccaaccaacccggccaggtctcttacctccaccattgcgtttggccacaatgcccctacccttgttcggcaagtggaatgctttatggcctatagtcatacttattttcactaatatatttttttactgcaatttcactaatattattaagactcagttctttttttaataataagtactaagataaaacacatttaaaatttacatattaataaaagatatattatgttaaaaaataaaacaataataatattattattaattccccgtgcattgcatggacttacatactagtaaaataaaaattagaacatcaaattaaaataattttggtattaattgtttctttttttccctaatcttcttcctaaattttggcaaaactaaatatatataaactaaaaaaataaatctacaattttttttctttacaataaattcttttaccaacataaaaatatgccaaaaatattttataaagtatattagtaatattaattttttataagaaaaagtctaatcacgtatacataatttaaattataaaaacgagcacataattcaaataaatcaattatttcttaaacacgttatgccttgaacaatatgtgatttcacattgagaaattttttcttaattttaaatttttatttataatttttgtttttaaaattattaatttttattataattatagtgtgattttaattttaaacttttgataattacagtaatatttatcaatcttaattaaaattgtattcttaaaattaaaattataaatccaataaaaacaaaatcttatgattgattaaaattaacgtgttttatttgttttgaataaagttattatttaaaataagatactctataactttacatcaccaaaacatattatttttgaaatttaaattatattttctaaattcgaattacaatcttgtaaatatttcaatttcaatgcaattcaacaaaaaattaggtagaagattataaaataagaaagaatataaatatattttttcttgataatttcgcatcatttactggtctttaagaagacttattctcatagtacctatatatactgcggatgatttggtaatattccagtttttccgctttgattttttaaattagtatatttgattagttgtaaaatttgttaggttagtgtatactcatatataggtacagaaagactagctagagaaatgaaacctctaatatgcaacgtagatacataagaatggcaaatgaggaaaagaattcgggaggagctgtaaagaaagaaggagattcggatgatatatttttgaggaagggtatccgtgcctgcttaaactggaacaacaaagaatcctcacttattttcattcctcgaggatgatgacactgagattttgaatagcatcctcagaagacaagacgaaagaaagagagaagaagaaggcacgtccacgaaaggtgcttgcaatagcagtgctaataataatgttggagattccaagaattacaaggccatgtgaagatattaaagattcaagaaatgaagggatgtgaggtgaagtttgttggaactagctctccctagatctctgaatatctacaagcacttcttcagtttatctttaattcaaaaaataaactctatgcatttgttgcataacaatgttatatatcctttagttgtttatgtaacaaattaaactgactcgtacttcacttatacatcaataaattcagatctttcttttcttctatatggtatcacaacctaattgcctgtgaatagggtaccactgtctgccctcctaaatccatcaccatcaatggttccgtaacgagaatccaaattattttttaatgttctattcagtaaattaatttttttatctgaatatgttattaatttcataaaatatatcttataaacaaacaacaccgtcaccactgcgttcgccacagtgcccctccccttgttcagcaattggaatgctttgtggatgctattgccgaagagaattaccctgtgccctgtgctgcatgccagattagtgaaggcatcaaaggtccttgcatacgtttatcaatccatcacgatgataatgaatgatatttatctcaaatacttgttagatttcgttgcaatcaattaatcatgatgataattaattataagttttattaatgattaataataaaggttttaaattacaattgcaatagtggaaaaattttaaattctttgtataattcaatatgatgaaagttgctttgtcatttgtgactatggtaggtaattgggcatgttttccagccgatggtgacactagatgatttggaccaaaaaaaaaacacttgatgattataatttagatagcagttattagaatgtggattttgacctaactcaatcccaaaagctagcttatagggtgagggattgttctccacttatatactctgacttggcactatctctagccgatgtgggactcaagcaggggtgtaatggatttaggataggctatgatatcgtattagaatgtgaattttgacctaactcaaccccaaaagctagctcatagggtaagggattgttctccacttatatactttgacttggcactatctctagtcgatgtgggacttggattatttccaataacagtacaacttggtatgtgtaatcacgaggcctatttgattactttgatcatttgttcgtgaaattgagagagctaggttgccttatttgtaaaatgtatcaatatatcaaaaaacaattaataaaagagatttcaaagttacttcaatttgttgcaaacaaatgaatctacctagaccttgaaaacatattaacttattggaaagcatcccctgatatgaagtaaaatatgtagacatgtaatccatatataaagaaactcaaataaaagttacatttataaataataacaatgtacgtaaattatcaattaaaaacaatttggatcaataaacaaatttatgtattttgtactgttcaatttaattatagtcaaacgctaggctgaaggaagagataattaacaggaactagaccaaaagataatgatataagaattaaaaaattattatttaatcataagacacatttatcaaacatatatgtattcacgaatttgtatatatttaaacatcaaagtatctcagcacacatttgtccttgtcataataactataaaatcttgttacacatgcaatatcaaatgttaagtggaccaaacaaaacattttattttttttcttatcttaaaaaagtcaactttgcttcaaagaactaatgcttacggggcaagaaaaatgtctcacatgcaagtaaatagccttggagttaacttaacattagtaatgaagatcaatttgagggatatttattttttatgattttgttacaaactaaattgataataaattataattttttttagtacgttgggtgtgtaaatttttttatgatcaaacattagtaatgaagatcaattcgagggatctaacttgacttttttatgattgcgtaaatttttcgttttacacaatgattagagattgttgggtgtgtgtagtttaaaatctattgctaagatgttattaatattattgaatgtattagtatcaagttagatttatttttgttttgtaaggattaatctaatggttatattttgatctgagtcttctattttgaataaaatattcttacattaaaaagataaagattaaattatattttggataaataattatttttgtttcatataatacataaattcatccataaatatcttaaatatgctcttttaatacgaaaatgactatttatccaaatattattaaaattcaattcaatctaatactttttttttcactttttattgtttactttttgcagtccttattaaattgattcagttatcaatatctcaattttttttcccgtccaaaaaaaaaaactgaattttttttattagacagagactatatctagactcatggatatatatatatatatatatatacacagaggtatagagagagagacagagagagtagagtaaggaaaacttctctaatctgcaacgttgatacataacaatggcaaatgaggaaaagaattcgggaggagctgtaaagaaagaaggagattcgcgcttaaactggaacaacaaaggaatcctcacttattttcattcctcgaggatgatgacactgagattttgaatagcatcctcagaagacaagacgaaagaaagagagaagaagaaagaaagagcgaagaagaaggcacgtccacgaaaggtgctggcagtagcagtgatgaattgccaagtccatttaaagaaaagattcaagaaatgaagggatgtgaggtgaagttgctgatacagaagaaactatgtgagtcagacttgaatccaaacctaaacgatgccagcttctctatgaaaattgccaacaattttctgacacaaaaggaggagtcctttctagaggaaaacgaaaggatttctggcatgcacgtcattgtgttggatccttctcttagagagtgcaacatgtgtttcaagaagggttcaagaagctgcttctacgacttgaccaatggatgggacaaaattgtgcttcagaatgatctcaaactgcatgatatgctgcaggtttggtccttcagagtctcctctcttctctggtttgcacttgtcaatctgtgaacgaagatgctgtacatgtgatgtgatggtctgttatttcaatcttgataattactgtaaaagatctatgaatgatcaccctcaaaatcctctatgtcaatttagaagggtctgaagatattattcacttccaacactttcaagaaataataaaataccaattttctttgcttgtacatttatccttcatttactgcgttttcatttgtgtctttgttcccttatttctctttataaactagaaactcttattgcacccttttgattattcgcttgtcaaaatttctagtaaggttattaaagcatacaaatgtttttttgcatgtgtcatgcattgaactcttaagcagtatagtcctttgcagtgctaagagagggtggaaatggcatgggtaaaagcaaggaaatgaattatgtgtaaaaggtagtagtttatattatgtatgaatgattatttctattaattagaagctcactaagttctcctctaaagagggtgtctcctacgagcatttggagtttattggagactccacctctcaatcacaccatcaccaacaacctttatcgcacttaccctgatctccaaccaggccaactctctcttctacgtgctgtcaacactagcactgtgatatgtttgcgttgttcagatagcaacagtatccttcattcacatgacgggatgaaaaatctcgaaaaaatgatgccgagaacactattgcttccttgatgcttgtggccttaaaggagcataatcatctgtgagtgagaatgacgtgttattaaggtgtctcccatctcctgttattattgggtattgtttaattaaagagtagtgcaactcggtatatcaaatcacacggcctatttgattactctagtcatttgaaattgtaagagctaggttgtcttatttgtaaaatgtatcaaagtaactaataaaagagatctcaaagttactttaatttgttgcaaataaatgaacatgcctagaccttgaaaacatacatttaacttattagagaggttctcttgatatcatgtaaaatatgttggcatgtaattgatatggagaaactctaattaaaataatttggattaatgaacaaatttaagtattttgtaatatgcgatttaattataatcaaaagataggttgaaagaagagataattaacataaactcggcaaaagaaaataatcaatgttataaaaatcggtctggttattgacccagttgaggtagtaggtcagtgatccaaccggtggaccagtaattggcctggtttgggccggtctatattaaaaaaattaaaattatattatatatatgtatataactaatattacttgattaagaaaagttcatccataatttcatactcaaaaatccaaaataacaataagctaattcgcaatgcaaaataaaaattgcataaaataataaacggggtacaagaagcaacatctagtcaagcccaactaaaaaaaactaaactctcaatatatatatatatatatatatataatcttctcttcgatcatctctacatttggaggttgttctctctctccctccacgacggtttcctcttattcgtcgccatcaacgttgctccgtccgaagtcattctcacttcctccatcgtcactctctacaccgtgttgcacccacacacgctagtaacgatggagatggcatgccctgctgcagtgagcgtgagtgcctgaggccctgagctaagccgtgaacaaatgaagaattgaagatgaagaaaagttgaagcttttttttgcgttttatgcgtctgaagcttttttttttcttcaccaactcggtttgggtcctaaaaatcggtcagattttctattcttcctaaaaccgtatggttttctttgggccatatgcatgaccggttcattagccaactcggcccgattgatactaggttcctagttcaaccggttcaaccggtcggttcgaaccaattttaataacattgaaaataatataaaatttcataaattattatttaatcatatataagacaattttatcatacatgcatgtattcacggatttgtgcatattaaaacatcaaagtatctcccacacattttcctttgtcataataactataaaatcttgttaacacatgcgatcaagtgttaagtagaccaaatgtacaaaaaacattgtattaaagtttttttcttatctcaaaaaaggcaaccttgcatcaaagaactaatgattacgaggcaagagaaatgtctcacacatgcaagtaaatagccttggttcttgtttatattcttttcttttctaatcttaaaattaaaagtgattcttgaagggcaggcaacgcattatttcatatatattagcacatatataacaacttattttgttcgaatttatagtggtcttataaatttagaattgttaaactgatactcttaaaaattaaaatcagataaaaatagcttaaaacatggtccatgaaagcacatgatgtagtaatatatataacaactctcagactattcttggattttcaatcatacagagagaaaatgaccaaatattccaaactcaaactccttagttatttcataaacgcagccataggtttaatttcataatacaagaaaggtggtagtggtagttggttagaaaccatgaatcttgatctgatccttcctaacaaggcgagcatgaatgaggaagtgagaaacgttcttgcgctgatcaccttggagttggataatcttgccaagctccttgtcatgcacaacattgccattgcagcaaaactctttcttgaggtctttgaggatcttctcgtagctgaactctttcttcagcccttgcactgtggtcagactcttcttcccattcctctgttgtatgcggatatgcacatactcttttgccccgggggcatctgtttcttttgcctccgcaaatgggtcgaaagtgctcgtagggatgtgataaatacccacttcaaccatatatatatatatgtacactaatcaccaccctagctgcaacaaaatgtacaaaccataagccacatgtgacatgttcatgcatgcatgccaatatcaacatatctaaccataacaaatctaaagcctcctattaagcatttctttccttcacgctgttttattgttttgtgtcagagatcatgaatgtctctcaattcattaagttagaaactaatctcactcgaggtgcgtgactgcttttgattcaaaaaaatttgcacaaagaagaaatcaaatacaaattttttcattaaatacatcttctctcatatatgaacgcaatggtgcattattacacagttatgtcaaccttatggattaaaatcaaaatctttccttcacatcttgcaagtacatataattcgtaaggaaagtagcaaaaaaaagagaataaaatgtctttcttggtaatagagacattaaacatggaactcaaactttcacaaacacaattttttagaccaagtaggaattaaaaatgagctaggaagatctaatgttgaaggagagacgaacctgtgagaaaggaggacttgtaaacaaagcaagagcgaattgagaagaataggtagtggtgggggtatatatagtagcggggtgtgcgtgacagaataagcaatttaatagcagtgaaattttttaggacaaattatttacaccatgcaattaaacatttgatagtataaagtaattttttaaatgtgtgtatatattatatattgatataagtttacagatgttaaatattgatttacatgtcttaaaataaataaaaaattcttacaatgtgacaatttctcacagattgcaatgggtctaatgatggttaatagcagaatataaggtgtttttgggtggatggagtatcctattctccatgggattgatatctggttgtaatttaaggcatagaaacgcaagataatttgtgtggtatatagtagttgtggtagagaacaagaacaaaggaaagaagaatctagactcaaattgctttggagattctgttccttatgcttgtctgagtgttacagatacgaattcttttaatttttatcacttctcaatttgcattattttataatatttgtctgtagaagatcaaaagaaagatcgggacaaaaaataattgtttcaaatccttttacaaaagagaaacaaaattattccagtccaattaatcatactgcaaaggaaattattgatcagtatgatatttctgggtttttactttttatttttacatgtgagtagacttccctgccttctaacttctttccaatgcattaagtaggtttatttatatctttctgcttttaaattcaccgtaagtatataatttaaatttgaaatattttttacaattttttataatattatcatctaatgatataatcatataaagtattaattaaactcttagatttcttaaatagtaattaaaaatttatgcagatcacagtgatactttctcccagtttaacaaaaggtttaaatatatttttatctataataaatatttaatttttacattttatttctaataaatttttattttactttaactctctaataaaataacaattttattttttatcattgacaagttctaataatttttttcatttatcaaatactcaaacaaaattattattttattagaaactcaacttaaaataaaaatttattaaagaataactacaaattttaagtatttattatggataaaacatatttaaacctttaacaaaattaacatatcagattttttaggaagatgttgattataagcctatacacatgaattgtttttatgaaatttaattgcaattttatttcttgaattttaatctctcaatttctctacaaattccagtattttttttataaaacatttccaacaaaataacattatatcttcttatagatcttcttacaaatcttccaagcacaacatatatacatatccaatttcccttttatttttactttttcttttattcaaagaaggctatgattaccttatttttcaccctaccactcttaagcaaaccaatactgaacagacacaaaatgattaatacaacagccttcatttttcattttttatcaattgcataaaaattacaccttgaaatatctggccaaattagataacatgttatcctcccctcaatattctactgtgccaacacaaaacagcaaccgacaagatcatcatgccaccaggagtgagcagttaaataatgggttgatttgaatgaagatagatcataagctattttggtacagtcatgaaactataaattcaaaacaccacgctgtcgttataaaaagaaagaaaaaaaaaaaaaatcaaacattacatgcaaggttaaatcatctttaaaacgaatacaactaatttaaatcacatttgtaatccatcttgttaagaaacaaaatcctcttctgatatttccaagtacatcgcttctcttttcatcataatcaaaattttctactgcctttgacaaaccaaagaggcttcaattcattttttaaacatattgaatctcccaataatcttgtatcttcacagaagctttagatctttttccatgtacaaacagagcattgacaaggttcatctcaataactaggtgaagaaaaccaagataaagaggaaaatgaacagcaccagcaaacccaatatcatcatgatctgtccctttgcactagccttcttcatgaccattgccacttttttctgatatcataaacaatgagacacacttcaactttcacattcaacattaaaaatttccctcattatattaaaaaaaaaaaaaaaaaaaaaaactacatatttcattgcccaaagactcctccctatgcaaaggtaaggaaaaaggatattgtacgcagtcttacccttgcatatgcaaagagactatttccggattcgaacccatgaccaacaagtcaccaaaacacaactttactgctgtgtcagggctcgccctccttatattattactaattaatcacagcaatcagccagatagatcatacattttaatgcaataatggaaactcgaagcagaaactcacttggacaaaatctaggcgattagatgtactgtccatctcattacccagctcatcaataatcttttcctgaaacatcaaggctttgacaattttagaatgagaaatttcccaaggaaacaaaatcagcatgagaacacagctactattgaagacactcaaaggaaacataagcaccaccagttttgcctagtttcatacttttgaaacacaagagtaataatagaaatccgcagccttaacccgcaaggggagaggctgtttccaggatttacaccagtaacatccaactcacaagacagcaacaaggctctcccactaagcaaaatagtaagatcacagaccaaaaacttgtcaaatgtcaaatctacctgcgcaaggagctcttcatgtatagtaagtccaacacctcctattctttgtacacttaaactaagctcatccaactcctcatcttgtctcctatcagcaccaatagataaaatataagacaaaaataaaatagaaaccagagattgattattttccaaaaacacttgagcactgtatttccagcctttatctgtgttaaggctacctgccacagtctttactctcccccattttctttttcttccacagaaaaaaaggggaatccatcattttagttaatatttcttatttaatagaaatagtataatccaaacaaaacttaaataattagcaaagatgatattaaaaaacagaaatttataatttgtaaagaagcacaagaaaaatatgttcatgtgtccacaatttcatacagaggagcccacttatgtctcagaaagcatagaggaggagtggacaatataattaaatcaacttaagaggtcaaactaattaccagaatattttccaccttgcatgcacaaaagtcacggtcaagtgtcaatttgtttaatatcaagaagatgtgcacaaagtcaagtaaaagcaggacaaaagacaaatatttaattcaatgccatataaagtgagagagagaaaatgggaggaaagaagtactttataagaagcatctgcctgtccgattctgactctatgaaatcatcattatcctgggcagcatattggttagatgtagtttgatgagaactaggaagcctcattaattccttgtgcatcccatttagacaagcattgtttaagccctttccagcttgcactgctttctttgctgtgctcacctaataatgtattacaatcattcacaagcaccatacagataaaaaaaaaaaaaaaaaacagagagagaagggaatctaataggtgctagcaataaaacaatgttgaatgaactatacattaggttgagaaaaaatttgactgtattctcctaactcttactcaagttcagcatgttatagatacctgggtgcgagcatcacgggtccacttcctccggttttcaacctccacttcatcaatgccataccaagaaggatctctagaggctacagaaattgctttgtccaattcatccaccttcctatcaaaaaaattatattttagcagtttgaataggttgtattgcagaaggaaaaaccatagcctaagatgtgtggcaaagagaggctagacaaaagatgtgctagtagagttagaagtaattttctatctgttttccactctctgatttaacaaccaacaaagagtgaaaatcaaaacatttccagctcactccatttttactccccttcatctttccttacagacccaaagggaaggggcaaaatcaaattaaaagaaaacaagagggaaagaagggagagggtattgatgatcttgctctccctttattgggtggctaaaaaatacaatggggagggaatggaatgatgaataaaaatacatgaatataatgcattcactatttattaatgagctcttatattaactaattaacattaaaatttaacaatgatatttagctgaaatttacaaagatttgcatcctcacaatgatcacagagtgaacgattcttctgcttttttatgataaaaaaataccatgtatttgacataaattgcagcatatgtcagaatcattttggacagttatgtgcacatcactctttttacttcctaccacaataaaatttccccaaggaaatacctttcccttcctctgacctagattgtaatataatccaaacatccctctaacgtgtacctaataatacacaaatcccatttcatacaaatgatactagtaccacgttggaagaatgaatgaaactcattgaaaacaaaaatttataggccaaccaacttgtcagtggttcaaaaaaatacgattggtatacctgccatgcaatgctttcacaactagcaagaacttcctttgatagattggatcgctcgccagcatcagcagtcttttcccattggtgaaacgtagattgcagcttatcaatcttaccagaaaatgaaaattaatcagccaataaattacacatcaaccccaaaaccaaaaatcatagtgttatcctccaattacagatcgcagttgggttctatccaaaatccaaattttgcattaaaaaatggcatactcagatcaattacataagatattaggagcaaaaatatcccaattaataatttcagctcaggaatcaggcttgagaagatgaatcacgtaaagtcacggatccactaataccagtaacagagaaatcatacagaaattctaagtgcatcgcatgatctatgaaaaaaagaatgtaatctttattatccaaattgaaccgaaaacgaaacctaggtgatttgggaaaagagaaaatacttacagattcttgaatttcttgcttgacaacgtagaatggatcttgagccgaaggcatcgtgtcttgctgtttcgaaatgcttcactttaagcacagaaaattggggaacagtgtcacgcttcctctcttccctttcatttctcagcttaatatttttttgccaacaatatatatatgttcgaaataaatacaattagttggactttatttaaagataaatgagttaaaggaaataagaagtcatttttctaaataataaaaatgcaaacaaattcgtgtttttttcttttctttataacgagtatttttggcttttcaaacaactttatgatgtttgttattaatttttttaagttaatattttttagttcatcagaaatattataaaacaaaattgcaagatttatattggggtgataacaattaaaaagtaatgattagtacgtgaaaggctgctataaaagcaagtgaaatatcagaatatttggtgataggcttagttttttatgattatcattaataatttgataataatattttatacagttaatgttttggagctaaagttaattaattaaatccatactcgtttatattaattactgtacgttattgcaacatgcctcggttttttatttattatttaaaataatagatcataaattctaacaataattaacctcttcatttttattaatttttttttaaatttttaatatatctttttagttttatgtctcacgctcaagttagtaaaaaataaaaacaatggattgactgtaatatgataattgagattaacagttttgtagtacagtgaagtgttaaataaaatagataaaatacatgaaaattaaacattgcataaacatattgatttgccattaagtacattcagatccatgcgtaaaaaaatctaaaatggaatttattgtgttccacacatttcacatggtgatggtgtgcctcagaaatccaaagagaaaaaacccattgcttaatcaagtttcggataatatagggaagaatgccaccatgatcaaggtatgccagctccaccagcaaattgagttgctaaataagtatatatcatagtgaagccactgtgtgcaagtgcgttgatcaatcttagatgataaaccatatatagaaggcacatgaatttagaaacttacatcaaggcaaagcttgcatttaaaagatttgccaatgtcagtggacacataaacatcttgaccaggttctgtgtcaccaacttttcctggaagatcaaagttgaatcactcatgacccgtcacttcttgtgttcatcatgtttgaagcagaggggtatgatccccatcccaactagattaccacggtgaattctctcaaagctcttagcaataactcctttcaccccctatgtgaacaagcaagtgaaaaaatatttgtaaaacaagaaagcagtccaataaatatactcaagtagtgagactatggagttttactgtcatctattacaaattatgatatatattaaatttgttaactttttcaatacctaccataaaattagtactaacatgatttttgattgattaattgataatataaaatttaagctggtaatgtataataattaaacttacaaatataacgaaataacattttgtcattggtgagctcacgagtagtaaaggacccttggcagcccaatcttgagagccaagataatggtgtccagaccagcacccttttacagttgtacctctataaagtatgcacaatatcatattatgtggtatttatttgcataggaaacttcaacaaatggacttcatacaaataaaaccaggaatgatgcattaactaggccaaacaatgctttgtccattgcgaaggggcattttggaatatagaagggtatacaaattcattagtcaaatcaaaggttccaaactaacatttctcgcattctcccaattagtatttctaaccaaattaacaaattaatatttgttgataaaaaaattatcttaaacatacacttggttttctacgcatgttttcaccaccggtttaattactcatctgtgggacaattcaatagtgaaactaatttgtgtactagttcggcccaaggcctaaaacgtctttttttttttaaatctggcccagaatatattaacaagcgcttctgcacaaccttcccactcattctatttttctatcaaattgcattattctatttcatgtattttttgtattttgtatgttacatgatatcaaattgcatttttctggaaattaatttcccgagtaatgattaaacagcataaaggaatattttgggtatagagaggactaatgataataaaaaaacaataattaaaataaaaggggagtgtacttaaaaaaaaatatgcatgatatagcattcgccaaagaaaaatcaaccctcccatcgaaaataaggcccaggcccagcatatgcacggctaagcagaaaggttcatgtgagaaatgtatttcattttaaaattgtaatattaattctaattatgacatggacttctgggatgtaacctgtcacctaattttatcttaaacaatgacaaaaaaatcatgctcgattcagaattgacaaatactttttgtttatgtagttgaaggaaattgacttttttttcattcttgttttatatgttccacatttgtaatttatgtaaaatacgtaaatagctcattgagcttttcccaaaatgtaatatacacagatagcaagggagagaggacacatatcaaatgagattcttttaatggagagaaattagaactataaatatagattattagatcatatttatatgtttaagattaaaaaaataattatgcattaacagtaaaataaaacttttacattattaatttattagaaattattattggtattatttttatacatattaaattacatttataatttatttaaccattgaatattttgattttgaccaaagatcacgtattggatattgtatattgactaaaaatatgactaaaataaaatatataagtaggagcaaattttacttttataagttagttttgtagatttaagttaaacacaaactcacgttttataaatggaataaaagtttatcctaataagtgttgttatgcttatcaaaccaccactattagatcattaattatcaaactactaataaatgttcagttttacaaattttatgttgagatgtttagtcctcgacatgagataatgtatatgtttgagaactcattatgatcaaattaaaatatttaatgggataagcaagttttgtgatgtcaatttattatattcatacccaaattttaagatcatgcaaatcaaattttaaataagtgaaatattttttattatgtaatgtcatagtcaatattttacttatatttttaaaaatatattatgcatttagttaaatttatctaatgatgtatctaataaatttaagattttataaaaaaataacttatttaattatatattataagcaattttaatttaacggttgaattgataaaatttaatgtgtaaaaattattgaatataacaacttgtaaaacaataatattaaaataacttgtagatttattgtccttttgcaaaaaaaaaaaaaaacaaaaaaattgcattaacttaatgaattttatgagaaaacaacctaagtgtatcaattttcatgtgattcacatttctgagattctaagttcaaaatttgcatgatttcacttaattatttaggttttaaaaatgtttgatggacaccataatgctatgcaacacctagtaattgaaagtaaaaggagaaaaaatatagatatggtagctagagtttatttggtaggaagagagagataaagaaaaataagcgatataaataaaaatgtttaaaataatgagtgtttatgtttcataaaagataaaagatgacaacacctaaagcaaaaaaaaaaaaaggctaagacttgcaagataaaccaacaacgaaaaatgtcacacttggtatatatcgtggtcagctacacatgatgccaccacgccaatcactacaatggtgcgcatgctgctgaattttgcgccaaagggaagccatgttagagctcgaccccagtggtttctacaaccccatgcctagcatttctaatacctaccattcttgcctattgaatttttttcttagttgctcatttgtgtctgttcttctctaatttttattgaataccaaaaactaaaatgtaattacttccttttttaatttctcaaacaaagatgtactcatacattctagtatatatattagttgtatgattgatacacttaattgtgtctttaacaccaataggtaacatattacatgttaatagttaattaacctcttatcatctcgcttaatgataattaaattccataataggtaacaaattatcatgttatctcatctaatctcgtcatatatatgaacactaagaaaaaggcctataaagaagacttaattagcatcatataccaagtacgccttaaacactaaccactacgtcttaactcttactcttattgacttaaagcattagaggcatttacagttgtgaccttcctctcatcatatacctaactaaaaagatcacttataaagggcaccaacccttcaacgtactttcaacctgaaggtttgtgagagatttcctagctttgagccaataaaaaacaaataggatagaacttaattagaaatactttttgtcgttgttctcctcattaaaattataattttacttttataacctctataattaaattcggcattaaagataaataatgattattaaatacacctctaatttcaattgtagaatataaaaagaaataaacttaaaatgaattgaagccaaagttatgtatgtctgtctcgatatttcacgtacattgcaggtagattaattgtggccatatatcagtaaatgtttgaactttgaaagcaataaatactcgaaacaaatctagcctcctaatgcacgtggtttggcctacattcccatatcgttaactatgaaaactttttggctgaacgtggggtttgtcttcacttgttactacttaatgaattatgacatacagctaccttgtcagctgcgtaaactacatttttggtgaacactggatgagattgattggcatatatggcattaattcttgagtgtaatatacgcatttcttcaccatcgtaaatatacttcagtgctcagatactagctctaaccccacacccacctaaaaagaaagaaagaaagaaattaaaacacgtacaaaactctcaatcaattaattaatatacgccaacagaaaaatatattacatagtataatacaaaattaaacatttgcacgtaatccaataatatccaacatcagtgatgcacattagacaaccaatgtaaatttgcaggaaattaagaaagtgaaggctaagtgagtgagatatattgccgtcagtttcaattacatttctgtgttgcatattcaaaccgctggatccaggttgaaatgagagtgggcaaatgcaccccctcattttaataaaatcattaatatttgtccaaaaatattatattttatacttcctaattttatattttgcattccgtaatttcatgtatttgaattttattattagtgcatatgtaagagtaagtaaatgtatcctcttattttaataaaatgcacatatttatcttgaaattttatattttgtaccttttatcttcgtgtttaaactcaactatctcatatgataatgataattatcaatttttattttttaaaataaattgtccccactaacccagaatcctagatgcgtcatgacactgttttcaattcccattaatacaacaacaaaaaaattgagctgagatcaaataattaagtgacatataacaattactaatatataaatttttaattatgactaaaatcagataactgtgctaagtgttgattatcgtactcaacaccagtgctgtcactttacagccgccacctcaatgctgtgcatggcttagcttttagcaagaagattctgctccaacggtggaaaatcttatatagcagattaattctttacataagattcccactaaatcctgggagtagttattctccctgacaaaatttcatatccatatatgttgaatggtggattggcaattggtgcatgtgggccacgttgatcttcttcaacatcagaaactttcacgaaccatttccctttggtttcaatttacacagcttttttcagaaaattaaagaaaaaaaagaattaaaaactttgacaaagcaaatgctgtgccagaacagagatcatttccgtgtactaattttctttctccttatagaattttaactttttcattttttatctactaatagttttacgttaccttcctttcaactttattttttatattaaattaacgtatttaaaagtcacattggaatatatatatatatatatatatataactatgtaatagacgtaaaatatttattagttttacttattaattactatatatttttcattgagaacctgactaattatttttaacaaatatctctttttaattacttttttattattcataagacataaatgtaagacccttacttaaggattaatatcaagtttcatcacaattaatatgttaatgttggtagattataattaatttgaattggatggatttatttaagctccttaacaattttttccacttgcaagactctatttgagatcttgttcacattacatatttcatatttgagtctttttattttaaaatgagatcagttttaagaaatgttttcctttttcattaatttacgtgactttatatttatattttcaaatactgttacttaaatttaatttaatttaaattttaagttttaatgcattgtaaattaaatatatattttttaaactaaaaggaattttaaaattatcatagtccctataaccgtaatttaaatttattttttaaatttaaagttatatataaaaaacatatttttttatatctttcttctaaattttaaaactactatatattttatttattttcataaaataaaataaaatatatattaataatattgaaattatttttaatttagaaatttcatttaaatttaaaatactcctataatatactaaaaatgtactaaaaaaatatatttgtaaccttatcaccctaatcacaaacatcagtatatcatatatatccttccctcttgatgatatggtaataaaaatgtatgctctaggatgaaaataagttaaagaaaaaacaaaaagaggaagacaagacaaaaaatggtcgtgtaattagggtcaaatgtgcatcataagtatttttttttacacaatttccaacacttgtattcatgtgtgttgttgaaacttcgactcttttgtctgtttcctcgagaatagcctgtctttatctgttcgccaccaattcaagggggctgtatataccatcgtttcttgtagtcttccttagaattttcaagcacatgttcttcaatacaacattttaacccgaagaggatctagaaaattattaaatgacacgaccacaatttaatcagagttaattttcaattaatgctccattaatagccaataatcaaatgtcactcgcgtttattaagttatatcattatcaaccttgatttgtgatgaatttggatatagggcgtggaactggtgtaaagcaaaaggattcgatttctccttgtatgtttggaaaatagaacccctgagtgccgttgtatgcatgagtgagcacgggtctacttggtttattgttttgggattgggtctactatggtgaatacatggctgcaatatttatgtgatttcttattggatcatgattgcagcatcacacttactatattgtgcttgtataacttttctggttgacacatcttatggcagcctgtttattaatattaaatactaaatttttttttataaaaaaataataatttatgattgaatgatagtataaaattatttaatgaaagaaatagtgaaggaaaaaattaatcatgagttgtgggcacttattgaaagggtaaatgttctttatgtcaagaggtgcgtgagcaatttgtataaatatggagaaaaaaaacatacaatttaaaatataaaaaaaaaagatgttgagaaaataattttttattagtttataatttattaacaaattttattgtagataacatgttttgcataataatataaattttcaataaaaaaatcaataaaagaaattatcaactttatttaatggtaatatactagtagttacaaatgaaacattaatttattataaataataatgaaaaaaaatactttttagtatactttttatgtatgaaattttaataatttttaaatatatttattaacatggaaattcatgtatcggggaaatatattgaaattattgcatgtaatatgtatttaagttaattatgtattacatttaattaataaagcatttaatattaatgtgaaattaattttaattatataatatgcttataaatttatcttattataactatcttatttttaagagtaaagtttgtaataactatcttttatgtaatattcttttaatatatttattatttattaacatgaaaaagtatatagcttagaaacatgtcataattaattaccatgtcatttaatagtttaatttaaattaattatatattacattgttaattttcatggaatatatattacattatttaataaacatagtatttaatattaatgtactgttaattatttatatgtgtatatatatatatatatatatatagagagagagagagagagagagagagagataagatagtgttaaatataaatagaaaataataacaatatattaatatcatattacaatattttcatgttttctcgtattattagtttaatatgtatttattgacttccatcttattgaatttaaatattttattttaatttattatgtttatagttaatttctcaaaatttatgaattttcttcaaaaaaatatatattatatattcatgaattttttgtattataagattaagcatttgattaccttttatttcaacaagtttatacattataatatgctccaaataataatgaaaatgataagtttcttgatgaaactatattttcaggtatgaaattcttaattttcaattatgataataattttataaaaatatttatcaatatgaaaatttattaatcaacataatatattataatagatgaatgtgtatgttatagtcaatgtattactgaagctaattatgcttgtatttaacaaatatagcatctaattttaatatcagttaagtttattaatataatatatttataaatttattttgttctaaaaaattaatgtatttagtatattttttagatattaattttaatataattaattttacaataagaaaaatttaatatattttttcagatataaattttttataattacttttatgataaaaaggtttgaatatatttattaatatgaaaattaattaatttgaaaaatgatttataattaattaatgcaaaaatgaatattattatgtatgttaattatgtattacatttaataattttagtatttaatataggtatgtatttaattttcatgatacaatatgcttataaatataaaaaatctaattcaattacttaagcaacataagtaaattattataaatttattagtacttaagtttgatttttatggataaaaatgtttataagttaatttattctatacttcaagcaaggaagatttgaggttagagtcttataaataaataaaaatatgatgaaaaacatatatttactatgatgatcaatgaataaagattaatgatcattgaaattgatgaatatttcacagcattactctggtaacaaaaaatatagtaataataataaaattattttctatacatatgttattattaccatttaggattcttatttaaaagcaacaaaatgattaatttttaacaagttaactaaaattctaaaaaagttccgctatttatttgagtttttatttttattttcaaggactaatattttttttacgacaaggacatgttataattcactataattttaggatcaaatgactattcctcgtataaatatagatgcattagagattcacaacatatactcaactcaaatttatttatttttggactgtatactaaactcaattaatcatcacttatatggaaaaggttgtgaatgagtaggtgaaaaaataaaaaataaaaacaataatcttggtggactcatggaaagaaaaaaaaattatataatcatctaataataattttatgataaatgtgataatttttaaaataattatcttaaactaatttaaataataatttataattaaatgatagtataaaatgaattaaattattcgtgcatcaacattaactctaattgataatatgagttattagtaataaatgcgatataaataaaaataaaaggtagtaattgaattatttaaggtttagacggtcagaactcagaacagaggtgttgaaaataaaaaagatagtgggcatgtacatgtactacgttgtaaaaactaaaaagttaatcctgtgaggtaccagagttaaatacgtggacacctatcattcagtgtctcattctttccccttcagaaagaacgaacttgctctctctttgctttgctgtttctcctataatctctctgcaaacttgttcaggtaagccataatattatggattttgactcaccatcatatatattcagtcaattcaagttcttatggtatcagaattaattcaagctgactcatctctcatttcacaactcattttttctttgcatattccagcaagaaaccactttagaatcaatataaagttgggttatttcaagcttctgattccaggacagcaacaacaacaacataaaggtggttccttttatttttcctcaataaaataccaaatatcttattgtatcaaatataatcaccccctgtgatttatagttttggttcttaatttctcccctcaatttccaaattctcctttttgtcttttgcttaaaccagtgaaaattctagttcaataatttgagataattttcttcacatttgtgttatgtgactatgcaggaagtgattgatttgtgatggaagataaatatagtctaggcaggcagcatagtgggatatggaagtccttgagagatggagattttgatgaagaagaagtttgggatgttttcaagaacagaagtagtgattatggtacttctggggttcgcaagttcaaagacaaagatcaatcctcttctgttcctgttcctgttcctgttcctgctaggcctagttcagccagaatgatcccaagatctagcaatagcagcagtgctagttcctccaatgaagataaggttcttcagcaatcagcacctgtcaacattcctgactggtcaaagatttatagcactaaaccccccaagaatagtgctaattcaaggtttgatggtgattatgatggtgatgatgatggtgttgctaactatggtgggagtagtgatgaggatggagaggaaaatgatgacagtgataagcttcctccacatgagtttattgccagaaggcttgcaaggagtcagatatcctcattttctgttttagaaggtgctgggagaaccctcaaaggtagggatcttagcaaagtgaggaatgctgtactctcaaaaactggtttccttgaatcactataaaggggtctcttgagtagtgatgtagctttatggtaaaacataatcaattaatttttcatggtgtagctaaaaacaacaaatagtttcttctactttttttatggtatcacctgattatatggggtagaattgattcttatgtgttatccaaacatgatagtagtagctcttttacatttgggatgtatagtggggtttgtagttagaggttatttaggaatggatgttgtgttcatatgcttggggtatataaaagaattgtttagccatttaccatgaaaacaatgaatcaaattggttgtggcaatcataactggtttcatctccttctgttataacaaattcatgggatcagatgtgtggttttgagcatccatacaaacttaatggtgaatcataattatagagccataaaacattttgaaggatacaagtgtttttctattttactttgacactgattttttgttttcttttcccctttgttttccctgtgcacaagtccaactgtccaagccttggtctacttccctattcctttattactctgtattgaataaagattctgtgaggtgtatccatccacctttggatgaggaaagagtgataagaagtgatgggatagaaaataagaaatgtgatgagcgaaaacaacagatacaattatacaaagaaaaagaaggtggagaaggagttgttagaaaacagaagtatataaaaattattactctctacatcattgatgcgtgaatcattttttttctatgtttttaatgctattttttccccatttggatgctattacctaccgtattttttacaagaaacaagtgataatatattttagactattacttttttgttgtttttagtaaaaaggatcggatgtagtatagtattaagtgaaatcaaagtccatgacaaaattgaataacccttacacgagtcggaaaataatattagttatacaacttccacaaagttgtaatatacatagactgtttgcaattttctgagtccaataaaccaagggtttgccatttcacttaaaagttgaaatgagttactcgtttgtgtaaagctatatgagttgagaatttctaataaatgtggtataaactcgattagcctcaaataattgtttgttggtccaatttagaactacaagcatttataaatctttaaaataacgagacttcagaactctgtaagaagggtctaaattattcaatcatgttgtggggtgggaaattgacatagacattcaccaacttcgtgtcatctaataattatagactctcaatgtatagtatctaatgacgtgtgataatgcgagaagggaaggggaaacagaaacacccagtatgtaggagtccctatcaattttcagctttgatctccataagattaatttaatacaacctacgtctagtgtacgctttttgtagctcatttcaattttaaacgagttttatttttttcccaatcaattttttacctttattgtctgtttcgaatatccatgccaaaaaattattaaatgcaaatacactgattaagacctctttttttaaaattttaaatcagaaatacataactgataaaaaaaaggagaaatacttaaagaaataataaagttatctattgtgcacaattctagtagcattatagtacagtcaacctatcaagtatcaacttctttcacgacagattccgtgtttaatttagttctccaaatataaactacatgccactgtaggaggaacaaaaagtcaaatattaccaacaggatgttttcaacatatttttgaataaatttgaacaattattttagtgagacccaatatatgaaattaattcaatgataaaaaaaattaaaatatgtaactaacatatattctttattattgtaaaacattcatgtgtcttttgaatcaatgcaacctcatgtgagtttttgtatttaaactaaaaggggaaaaaaacttcaaaccttgccgtgacatataattcaaactgttttgtttattataaacattatattggtttttaataataaaaaaagttttcatatattatattgttttaatgattgcaatgattaaatgtaaactaaatggtaggattatgagtattgttttgattgatcaatttgtttcttgctttccaaatataccagtaccacaacataagggatatagaatgtacttgattaatctttgacacgtaaaataaaaatagcatcgtatttgtgtcctaaatcaaactagttaggtctagggacagagtaatagagtatgctgatttgtctcttgcaccagatgggacaacatacatagtagatagacagccatgcttcatagcgaaaatgtttgttatgaccaaaaaagcattatggaagaccttccctagaaaatgtctaaccttatatggggtgccttaattatgaagaggagctcattgatcttctcacttcacatgatatttgtttagcaacatgatagcttctcttaactaaataatccaaacttagaatggggtcgaatggctctaattcatctactatcatttaatacctaccttattctcgtttattatggttcaatgaccctacttaacaaactccttgccttgaagaatactatgtcaaacccatgaaacaaaaataatgaatttgggtctctataagccggccaattctactttgctagattagtaataccaccaaaggacaatatttgccaactattctagagcaatcctcttcctacccttattcctccatcagaacctagctactgaggaaattagaaaggtacaaaaagactaaggaaagtgtataacaggtattgcataagagggaatccctttgaaagacgaccttgattagagtttcctcttctccctaatccactgaagagtgttatttctagatctgccccattctgttgggagaccaagaaaattaccaacaatttcccaagcttcttttcctaagacactaataatatatatctcttttagtagcagtagaatatatttgccaaagattaatccagactttgctaagttaatcctttgacccgggacaggttaaaaatatggacagcttctccagcacaagtaatcccaaagataagagcataatcttcaaatagaaggtacgtaggaaagagttgggctagaaggggttcacaataaatctccatatgtaagagctttcttaataatcaattcatccttaaaatattactctcttctaaatactctattttttttataaaaaaaaaaaaaaaaaaaactactcaagtgatcccaaaagtataaaaagttgtgttaagtagttctccaaatattaaaaaataccttcaaaatagttcttaaactttgttaaaaatacattaacttaaattaaaagttatggttattcaatactttaaggattatttaaatgtttttcttaatttatggattatttaagggagacagtaatactttaaaaacgaaattaatgatttattctttctaaaatatttgagagagagtatttgaggcaagaataataaatgggcttgaggcctctgtaggactttggaacacatttagactgtatatgttatactagacaataaggccataactaacttagcccatttatccccagacccatatgctattagagccttctccaagaaagtccattctaatttctcataggctttactcacgtcaagctttagggctattcttttgtgccttcgctgctcctcttcaaagcatgaaagtcctcatgtgctatgactattttgtcttgaattaatctggctcctacaaaggtactcagatatggagaaatcaattatgttatagaaccctaaacttaacagtaacacaataatctttacaataccttgaacattaaaattatggggactaatgtgtctaaagtgattacattcataagtctgtaatattaaccttccaaccatgccttactgtcacctttcaattggtgtaagcatacctatatctttggattgtagtagcatgaaagaaactcttgttattatctccccatttcagtcatttcaatctaaatctttacacacagtagtagttctacttccatagtcctcctttgattactctccatttcctcacaagttttattattatgggggtcatttcaaagaactgttagtctttgttagagtctagaaatctatagatttgcatttgaaaaaattgaagtctttatgtgccactgtagtaggtatttttgcagatttttttatttttcagttaactattccccagcatcttccttacccttcccttgtctctaccattttttcactaaggttccacaatgcttgtacttttcccataatgcctcgtatttaagttttggtaaaaatatactgttattatgtataaatactgtgaattcttgttttaatacttcaattttttattggttttaattcatataaatttttaaaaatttaaaatggtctctattatcatttattaatgacattggcataacatgtcataaaatagtcaccgaggtaacatgtcttcatacatgtcctgcaatcactaaataatgttagcgaccatttaaaaaatatataaaaatcaaatccaacaaaagttattttgaataactaaatctaaattttggtatattaactgagactatatatttaaattgtacttttttttatcacttctcatttttggaataaaatcaatgactaaggaaaagtgatcagaactcacacctaacgtagttgtcactatagttagagacctgtctagctttttctttgtagagaaaatatttctaggattattttgccttgtgtacttgtatcccttgggataggtttgtttgtatagaagagaaaagaatgaaagagaaatggaaaaaaaaatatttgaattaaaataaaaaataaatgtgagactcactattttttaattttttccccttatatagtaacctctcccccacacaatcaaaccatatcctttgaagttgtgtttgtcagcgacaagatagggacaatgagcaacgatggagtttttttaggtggttttatggagttgatttgtgagcaagatttaatttaattaattgggtgaaggtgcgttcctcctttgaaatttttgtccttggtaaggataaggtgtgtacatttatgtttgtgtttttttttttttttgtcttttttatcaacaaaattgattcatttgattgaaaaaaaaaaagaaacatatattaataaggatatatcaatatttttcatatgacaagtattactgtaatgttgtgttaaggatgattacattaaacctttatttataacaaataaatatgatcagtattgattatattggataaatctaataatgactaataaagactaaatcactaattattatctgatcacaaataacagaacaatatgtaatcttaaaactctcccttaagctcgagcttgttataaatgtggtcaatttgataaaaactaaaggcgattcaagtatgtgattgtatcggataaacatgattcgatggcagcaacaaaggctcgcaatgacgatgaagaccactgtgatgcttgttggagatgtgttacgtgtcgtgtgcgtgatcatcatgcaccaagaccctatgtggggggcatgttgtggtgttttgaattggctatgcacatggatggcatggtggtctttggctaggtcgctagaaagagacaaagtgcgatgatgcgatcgctggattgtgggtcaaccaaacaacgacaaaacagagtcaaacaacaacgaaatagggttgtcggaagaagatgagaatgatggcatggtcaccacgctggaaaaggtgtcacatggctatttggccaactattagttaggtgtgtagatacaatagccaaagcaaccaaacaaatggaaatcgagccaaatgaagtaaaaataggtttttctagaaaagaagaagcatgatggggaggtcatcggaggatgggtcattcaaaaaacaacatcacatgttgattcggtgcaggcgcgtgagtgtcacgcatcagagggtggcgacatatgacagtgagatttgcgatgttgggttcgttggagggagacactttcgatcgtctaggtacaccaacgaaaatgcaacatagtggcaatgtaatagtgctcacaatagtcatgatattattcaagcgacaaaggggctgcgattgagaaaagagggaaaaaaacaaaatggaactaaaattgtttggttcgagacaatggcaagaatgaccgcttagaaaagtcattaggaaaggagaaatggtcattggaagatgggcaatgagcagaagatccaccggggacttgacagtaagtcatcgatggagcacgattttcactattctttgtgaagaataatctaaatttttataccatacaacagtattttactataatgttatgtgttaaggacgacaacactaacgatttatttataatgaacaaatataatcaatattgattacatataatcaatctaataataagtaggggtggaaataggccaggccaggctttgataggcctgagcctggcccgcatcacaatcattaagcctaagcctggcttgttacctgttaaacataagttattaaggcttgagcctgacctgcataagggcctggcctggcctgaaagcctgtatacaaagcctgattaaataaaaataaataattaaaaataaaaataacataatagatatgtttatctcataaattataaaatttcaaattcttataagttatagatatgtttctcttaattattttatgaaattttcaaggtacttttttgaagtggttgatcatccaccttcataataagaaaaaatatttttagaaaaataaatatattattttaagttttaatgtgtatatgtatatgtgtatatatatatatatatatatatatatattaaataagccagcctgataggcctaataggctttttttaaagcttgagcctgacctttttatttaaacagacttttcaaaaagccttagcttggtctttatagtaaacaagccaggccaggccagaccaggccttaaataggccaggccaaagacccctgataagcagcctggcccacttccacccctaataataagtaatgaggactaaattactaattactatcttatcacaaataacaaaataatatgtaatcttaacattttattttcactcaatttatcatatatattttttaaaccaaacaacctaacaatactttgtttctctcctcacacaagcaaaaaagaacattagatctacctccatcatactatatgaagattggagtctcctccccactttctctatttctcatgttaaaagagaatggcattaaaatccctacataggaccaagctagcattttcagcatcaaattagatagacccagtactattccacaaaattctcctttgactaagtagggttgccataaataaaagcgcatgtattctacaaaatttctactcttattaaaaaaaaaaattaattattctgactactcttattaatttgaattagtacttgcatggatgaagttaagagaatgggtttcgacatcaactttgactttatacttacatggatgatgaatacatttttttgtataagggttggggtagctcttagtaccccttaatattaatacttttactgataaagaaaaacgtcgtctggttcaagttgagtttaggtaactaagtgtttcttcacgcttaacagaaataattaaaacacgcagttaatgggtttgtatttaattcactaaaaatagtattattacacacacacacatatatatatatatatatatggatcagtttgaattttcaactgcataagcatgaatctcaaatagcattaataaaaatagagtcctgctatttagtgcaaaaaaaaaaacgcacgaatactcgtgcatattttgattattttctattggttaattggaagttatgaatggaaaaaataaattagtgcatgtggttgatgtaaaaacacggtgaatatttggtatattatttttcgtactaaaaagtattatccttgaaaataaattttacacattaaaatataattttaccatcagatttgaaacgcatgatcgtgcaattattctttatgaactgcacagttgatcatgttccgtacatatgtaaatggataataacccacttgagattccagatagattccttaaaactggtgggtagaaattaataaagaaaactagaaataatatgaagaacatgaacatctgtgtccatgaaaaattgcaattccttgagtgcaagctctctctcctcttccacatgtttttccttgaaccccatttctagcattcccctcatcatccccacatgaaatccaaattttctcaacctttcaatttggtcctcactcccacctcccaacatggcaccacacgcagccccacatgcatgcaacccaccgtcccttttctccaatacaacgcgttgcatgctttccacgtgttgcacctcctcaccaccgtccgattcaccctcccacaacgtttttttcacgtactgcgcgtcttgcaaccccaccgaccccaccgcacgtgatatctcaattatcacacgcaggactcgctccgggctcgcacgtgctggcccgtcgggcctcgccagcaactcaaacccgaacggaaccatcccgtccccggtgaggagttctatgttggggccgtacatgggcctggacccaggcccgtcggttagaggaaggtgttcatgggcgtgtgcattggcgaggttgagtaacaaggccgatgccgcggccatggcttgttggcggtgaccgccgacaagctcgcaggtggcgaggcatagggccgggacggtggtccggggggcggcgaaggcgaggtggaacatgggctcgaagacctcgaggggttctttggcgggaatggtttgtttgaggtgggcttcaatgtcggcctgcaaggaggcccagtgggggtattgggaagtgggcattctgagcggtgcgggcttgacgggtaaggggacacgggcttggcttgatatgcgtgagaaatgaatcttgaagttggcgttgaggagaagggctccaaccatattgagagagaaactaggaaagtaacaaaagtgaggaagtggtgttgaaatgaatgaaggtatttatgggagaaagaggaagcgttgggagtgtgaatgaagtccaaggatggagggtgttatgttatgtactaggaatgcaatttgagaagcctagttgcttgatatgtagatgtgagaggtggacctgactgcattaatgggcacaagaactaggcttaaatagatagggaaaactaggctgctatttttattattttttttgtgaaattgagctagctgctaactttatgttggttaaagcaggtttaagttcatcaattagtttagttgagaaaaaactagaaagttatatttttttttataaaggaagaaaaagttagatataatttcttataaaatcaaattgaatcttatataattttttgatggattttaatgtgtcacataaaattaaaaaactttaagatttttttcatttttctattagtggtagatctcatcttagataacttttaatctgtcctatatctcatttttaaatattttatataaatatttattaaattgaatataattaattaagtaattaaatttaattaataaaatatgtaagaattttttataaatattaagaaatagaaaaataagcataaatttattttttatttatgactaaatgttaaaaaaaataatacataaatttgataataaaaaatataacacattaatgccaaaaaaaaattattattgttatgattgtaacattcttaaatatgctctatcaagtatgtttgaagttgttgatcaattatttttatacacataacgtgtcttgtttgcaagtatgtagtaaaatcaggagagtaccacgagatgttttaaaatttaaaatgtcattgtctatgtgataataatcaacatcaatattatcactaaatgtatctcgttcgtcatcgacaatcatgttatgtaatataatgcatgccaaaattatatttttcattatatccatgttccaggcatgcgatgaaccacatataatcacgaattgagattagaggacaccaaatactcgttccacatccttaagatctatccccaagatcttaagatttatcctcaagatccaatattaaagatattcttagatattaatattatctaatgttaattgagtcttaaaagtggttaacattatcacatggataattataaataattatattaatttactcttactcacttttgaattaaaaatgtatatagtttaccatatatataagtagaaattaagtaaaaaaatttccagatatacaataattcttattctattaaacaattaaaattaagaatttgaaactataaatttattacttgtaaaaaaaattatactattaatcattaagaaactatactacgtatgaatattaaaaaaattattgtaaaattaattaatatctttttatactattagtacataggctatttattttaaaattaaaatgaataaataatttgtaacatttatatttttttaaaatattttttcaaaatttcttttatttaatatttttattttaaacggatcaaaataggatttaatctttgtaacttcaaatcaaccattttttgttttcaaaatttgaaaaatatgcagaattagtccttttcctttaacaatgttaatgctgttaaggagctaaatttacatattttttaaatgttgaagatcaaaataatcaatttgaaaattaatacagaacctaaaactaattttaaataaaaatacaagaacgaaaaatagattttacccgcatttttatttaactcacccacgcaagtgggattggctcactacgttacttaaagtatagcacaccacacatataaaatggagtagttatgtgagttttgtccctagtcaatgcttaccaattatcaaacgttaaagtggagacatagacctgccacaaaaaaaaaaaaaaaaattatttacctaaatggcatgcgaccaaaaagttttaccatgcgatataattcgcttgtcagtccaacgaaatacgtgatagacacgtgacagtcagagagtaattcattggggagcccagtgaattaggtggacacttggcaaacagagagtaattcgctggggagatcaacgaattacgtagtaatagaaaaaaatctcaaaaatttcgaacggtcataaattttgatagaaatattcgatggaggcgtataatatgtcaaaatgctcgaaattcagaggcgagcattttgacgtattgtatacctccatcgaatatttctatcaaaagttaaatcatttgaaggacatattgcacttagacgcattttttgaaaaaaaatagtggaccaaaatccccttcccttcgcctctaaattttgagcgttttgacatatcatacgcctccatcggacatttctatcaaaagttatgaccgttcgaagtttttgagatttttccattgccaggtaattcgctgggctccccaatgaattacttcctgtctgccacgtgtctacctaattcgttgggctcgaattactccctgactgctagtgttcatcacgtatttcactgacaagtgaattataccacgtgacagttgataaaactttctgatcgtgtgacatttagataaataatattttttttgtccggacggtcgatgtctccgttaaagtgttacctaaagactaaaaagttccgtttaagtattagacacaaataattattttattttcaacgtgtttcgcgagtttgaagtgtaatctataaatttatttttcttacattaaaatttaacttttcgtaaaaggataaaatcatggcaacagaaaataaactttaaattacttaatcataaaagtttttatactgtgtcatgaattattggaagaaaaaacaaaactaaagcaagtccagtgaaatgaaactgagtttatctttcgagtcataaattcaaactctcacttgttatcttaaagtaaagtaaatgtaattttttctatgaatgctccttgggcctagaattttttgtttactgtgaattgaagtaatgtcgtcttcactgcaatcttttataagaaaataaaggaattatttcaaagttttatattgttaaacaaaaatacataaatatgtttatattacgttcgaatcagaatgaacctgattctttttaaaacggagagtttcatttttactaactggaatgggaattcatatgaaaagcataatctttttacttaaaatgagaatattttaagtgttacataaaaaagtaactaatctcttcacgaatgatctaaaaaatttatattatcatttatttacaatgtcgattatatgtattattatatgataatcttattaacttttagaaaacatatcgttgtaaaaaaaattaaaaacatatcaaccataattttgtaccctttttgaatttttaatatcatttatatgaattagcatacatatattaacataaataaaggattaataaaaaatgaaaaaatgattagaaacatcaaaatacacaaagaatcagtaatgtatatttttaaaaatatccaaaaaatatttatatttatgtataatagaaaaagaatactaattagggtattaattaataatagaaatattttatactaacattacataaaaattaaactctataaaatgacgctttattacacctaagtagactggacactggacagttgcaaatgcccagttgacaaaagcctaactaatttaattacgagttacgacaattctatgtttggttttgccgattgtaacaaaccaaacttacttttgaaatatttaatactttatgagtttaatctgtattatatatcatcactaatactactgtataattttgttcataacaaacaatgagaatttcttttaagagacacaatcaattgaacttattaatacatattagaagataacgaattagaaataagatctgtttagatacaaattataaatatttttttaaagaaaattattcaaaatatagaattttttctaataaaaaaactttaaaaaatatttctaactttatatttaaacagactataatcctcatctcaccttgatcaaattttttaacacaaacaatttttgtgaattctaagtttctaacccaattcaattaaaactagacaaatatatatggaatagacttggataaacttaatttgtttacatgatatattaatattattaacgttacatataattattttgtagaattaaagaagtatataattataattaaaatatatttataatattatttttaaaataaatattataaatataatattatatcaaacaaaatattatttatttgtcaaggagttgtattatcaatatataattattttttaaatattatactttaaaaaatgacattgtagtaggttgaaatgacctaaaatataagtctaaatccatccttaaagcaaatttatctaatttctttaacttgaactcgttaaaaaaatcctttaagaacagattaagttagtaagatgagttaggtcatgaacaccctatttcatattattccaaatactctgtttaaataagttgtctccaatgatgagttgacaaatacctataatttatatataaaaaatactaatacatttacataatatttttgcaatgaatcaaaatatttatattttaataatttcaaatcacccttttaaaaatctttatataattatatatatacttaatcattttaactgctagtctatttcaatataccatttttgtaatccttatttttaaattatattttaacagtttttttctaaaaaaacataacaatagttaaaaaaataactttatattataatttaattttttattataaatttaaacataaattatatatatttaaaaattataaattttaatataatatatttatatattgaaaagtattagtttgttataattttttattatataaaaataaaaatgtactgtataccatagtaaccatactacttatttttttaaaaaaatgataaattaaaattaatacagaaaataataaatttttccaaaggaggtaacaagtaaagtgagagtaagttgtgatacagtcagtaaaattatatcttgatgacttattgatcataaatttaaatctgaaaatagttgtttgtatatgaatggataaagtgacttacaattttcctcccccttccatgtgcgagagcctcctaagttttttttttggtcgcaagtaaagtcggcttcgtttatttcagaagacaagaaagagagagagattagaataagttggtacaccgtcaaatttggttcctcagaattgaggtattgtgtaagggcacgttctgttacatcgtttttcattttgattttggatggataaaggtaaaggtgccaaggcattagcgacctctttgcaaaacctcgatttgaatcctccatccaacgtcaaatccaagtcttccatttcactcacccaccctcaatttcccggtattttttaaacccctttttctctctttcaatctgcttttgtattttagagatggggtgttatgtttatgtttggtttttggtaaagctttcacctttcattgacccatgatcaattgcacttgctctgttttggggatcaattgaaattgaaagaccgttgacaaaacaatactaactctgaaatgcagtggttctttgtttctgtgataattttaggtagaaaacttcaaaaacaaacaaaaaacacttcaaccctcatttgggccttttactgcaattggtttcagttttgatcatattgcctggttttgtggcaagtgctcattgtttaatttggttttgcccttagactctgtgtttgtatgactagattatgctgacaattgaagctcagtttgagttttgcccctgaatagaatgactaaaatttgttttctttgaaggagacactaggtgggtgttagttgtgagaggttttggtagtttaaatgagatcttagggtttaaaccttggtggcacgatgcaccaattattttttcataagcatgtgccacatgataggcattaacaaattatttgagaaatttttgtgcaggattactgcctaagaaggcgaagcctccgagtttagtcagtctttgcgttggagttcttggaagacatttggaggatattgttgcagatttgagtgaaattgctatcaacttgccagctgatataaaggtaggttgctagagaatgattctgattcttcaaatcctttaataagtcatttatcctaatgctcatatttgtcaacaagtgaaattctaaatttatggtgttctcaatgtaaatgtgtgggaaaaaaagatttctccaggatttcccgctttctttgctaaagaaatatcctttgttgaggcacccggttaatattcttaagtggttgaaacttgtgttccgctcactgttctaaacacttctttgtttatcccttgttaaaaatctttgattataatgtatcttcccccaaaaaagaacaaaaagaatccttcatcctgcagcatgtattttatacatacatacaatacaaataaaaaagttagttatgcttaatgacagatagcagtggcagctattgctagaagaagaaaattgctgaatgatgatatcctgatcgcattagctgatacttcctgggaaatccttgatgtctctggctcagatgtctctgattttggcttgattaaagcagctgaagtatgtagattcattaaagctctagatataaggtatagaactataactttttttattaaaaaaatgaaacaattactatgctttaattgtaatgcaattgatctttgatgtctgagaaatgggaataaataagctgaaaaaacaagaattatcataatatttagtcttttcatgtatattcaaatttcagaagacatttcatgcaatatgctctagcttgtagtcttaactctgtagcttacttgatgctacaagagcatgtcatatgtcccattcaatggaccagctggtaggcacattttgagaaaatattttgctgtttgaactatatcatgagtttattagaagtgagtgatgaatgcagattgagttttatgcttagatcatcctcttccattgtaattttaattgtatttcatggttttacttctactggatgtggttattattaattttcttcacctagtttttggtccgtcaacaacttgccttgaggttagcatattgtaggattgatgtgatgctaacaatcatttttttagttttgtagtgtgtgtttttatattatacttctctctctttcagaatcacttgatatattgagactatttgcagccggtgcaccaaaattactgctaatggtatatccgagcttgtgaagcactgccacttattggagacattgagatgcgggtacatatcctgtgctatccactttaagttttatttctttgttaatgcaatttgttcattgtgttgttttagactgtattttgtctatcatttaagacataatctgaaaacttgtaattttgcttcaatgggccctttaggtaccatgttcttgttactattgtatctgtcatacttttgtcgttaggatctgtaaattgagttctcttgtaaagatgatcaaaacatatttacttactcatttatttataatgccaaaaactggctttgatataaaaaattgatgtatattctcacgaaggaaatgttatccgaaacttgggaagttgtaggtattgggaaatttattctatatttattctctcttttgttttaaaaatcaaattaaatcaaaaaggtagaaaattatgtaattttaaaattgtttagggtgcttttttttttttttttttttttttcatggtagtaatttcctctttattacacaatgatttttgtctaataaatcacattggatacaagactgtgttttgactaggattacatcattacaaaactcataacaggcaatgaaccataattaatattgcagaggatgtccaaggagtgacaacactgcacgaagatgcttgggtatatttaaaccaaggtttgatgattatgtggaggaggattcttgggaggagcttgatacaaaagaaattgctagtggggcacaatcactcaggtggcttgtgtgggtatgaacttgaaaacttctgtctaatttgtaattgaatgcaatttttgtccttactgaaatgcaaaaattcatgtatttccttcttagtttgatgtctttgtttttatgatagcattggttggtgtagagacacataggctgcacttcgtccagccaatgggggatggagtgagaattaggaaaaaataggcatgatggataacgatttttctttgattctcattgcatatagaaaatagaagttgctagtagtttaatattttttcatggccgacatttcttcaagaagtgattattttattttatttgcagccaaacattgataaaaattctttagaggacttttccactgagtgcccacgtgttgtagtaaatcctaagtcatcaccctttgggtttaagggaactgaggttcctcgggaagcattacaaaatatcatattggatgatgaagttgtcaaggacattgatcccagaacatggacaatgcatgggtttgcattgaagcccatctctccatcttcaagttccactgaattatcagtagctgaaaaattcagacttgcatttgtggaaagggacaaccgattagctccgaagcgagctaaaaatgcccggcaacatcagcgtcgtgcagtgagggaattgatgctgatgagcacaagagccaaggcaatggtcttagcctcacaagcaagcaagtcccttcatggccgaagctcatagaattctcacatgacatgcatttttcagttgctccaaaatgtactagtagtattaacttcttctgtatttagtaagaagttgttggtcatacagattttgaatctttagatatctcctttgacaagtcagaaagatcagggctttcaatttgtgccttgtttgaggtttctcacgaaatgaaaaattgttcagttgcccatgttatggaagaaatatgattgcctgttgctttgttccatttattgtggaaatgtaaaattaattttccaacatcattgctttggaagaagctcttgattcaaaaggataaaggattccttctgcatgatatttggccggaagttattgatgtggtactgctacctaacggtgcttctgctgagaggggccttgttttgtggaatggtgtgatgcatgtcaaaactgcttataatcgactgttatgagaatggttgatgagaaaaaggacagtgtctggcaatttataccctgttttgaaatatctcaaacggagaagacacaaattttctaaagcaaaaattttagctgcaactaaaattttgatttgagtcagatgcaaacaggctttaagctacaattattgtgcatgtttgaggcaaaagtcattttgccaacgcatcaggatccttgtttttgcatttattttgtttttatctgtgtgagttggagcttcttaaattcattttcaataaactttttgatttcttataattgattttagcttgtgtttggacacttttgtaatgcaaaagaacatgtcaatttgtttgaaaagctgttttgagtccttttttattctttgcattaatggtattatgtaacgattttttatcatcaattttttaatttaatttctttaaaaaagatttgtgatattttaaatagttaagatattttaaaaattgtcacaatttcacattcatatttttttttcttctttaaaatcatcaaaatatgtaaaaaatgtcagcaaatcatattactagtcaaatattttggcatttaaaattgtcataaattactttttataaaattaaaaaaataaattttgatgattaaaaattgtaacaaatgaaaccatgaaatgataaacaaggagggactaaacttaattttttgaaaatttgagggactaatgaaaacaaacaaaaattgaaggactaaaaaaatgtttatgcctaaaaaatataaattatttatattaaataatttgtattagaaaattaactatatatagaaaaaaatgaaaaactaaaatttaataacttctaatagtaaatactactagtagtattaaactttaatttataataaaattgtcaattttatattttcacaatcataacaatttgttgaaaaaacatctaaaaaaaggtttttgttctttgaaaataaattatatatacatagcaagataattatcttttataataaatgctaaaaattgtaattaaaattatttgtgattaattaataaattaaactcaatataattttgttgaaatgtttgagtggagtagtctgagttgggttgagctgctgccacaacacaatctcatacagcgcaggaatagaaggaaaagatagagaaatgtggaagagaaccttggtcggtgccgtgggtgctctccggcggccatattcgtcgggaggtggcggcatctcctccgccgtgaactcaatgctcctccgctctctaaaggatcactatcaagaagtcgccaaaatgaacatgccccctgtaagctctctctcactctgttatgtgctagggttttactttaggtttagacattgactaactcacgtgagagtggcacgtgcctagcagaaagtgagtcctccgtcgccgttcacgatcgtgaagggagctctggactcgcacggtccggttctgaagcgcagctacggcgacgaagaggtcagcatctatgtcatgcggttgttgacccccgaagacgaggattccgccatcgaccagctcttcatccacgtcgacgtctccaaacctcagcagaacgaatccttgattttcctctgcggtttgtacgaggatgctctggggattcactctgtttccatgaggcccaaggtccaggactccggctacctcctcatcccctcccaatacaccggccctgttttcgcgtcagttctgtgctctttgctctcaatttttctttgtttagggtttatgcttgtgtagtgtaggtctggagattggtaattaaattaagaagaagaaaaaaagtatgcactcatagtgtaaaatcatccaatcacacatcacggatagtaggtttgttgatttttacaaaactatatactgtccgtgcatcactgttaaattcttaaattaatgtcattgcaatctctagagtatatgaaagtataaggtggaaaaagatatatcaaacatggacggagattccacgtttactggtgatatgatttaagtggggaacaacacttaccgcatgagttagcttttgaagttctaagatggcattggaatcctagtggttgttgttggatttattagactactcgttatcaggtgttgttattggatcacctacaaatattcaatcttgcaagctataagttgtgtgtaatttccggggtaagcatgtctcttggagatttcacgttaactagtgatatatgaccaaaatagtatatatataggtggggaatcacttctctctaagttagattttgagattgaattaagttcaaaacccaaattcttagaaaaccgagttctatatttaggtataaaatgcagattttgggaagaagcatttaatttttttgtagatattaggaatttaggattaaaagaatggagatgaagtagaatgccctccactcagaactcttcaattgctgtaaggagtagtggtgtattggctctttttatttattatagtaataactattattgaaaatatctctaccgtgcgagttacttcatttcattttggaactcaattgtgagtgtttaattaaagtcaatgtcaatgtgatgtgattgattcattttgatgctctttccctgagaaaagataggctggacttagagaagaaactgcggaattgtgttttgcattttgggagaagaaaaaatttcttacttttggaagatacgaatacgcgtgttgtcctagaatgcccgttttgtgttttatcatatacctgttaaacttcgcttggaaattcttatgttttttgctgactgacttttctgtaaatgacagagaactagatgaaaagatgagagatgcgtttcacagttacattgaggagcgaggagtgaacgagagcctctttaaatttcttcaagcgtggctatatgtgaaggaacatcgaaatctgatgcggtggttcaaaaccatgggcttgttcattgatggaaagaagccagctacaggtgcataaccctccgagagatcaagttatgaattcaaaacttgcaagtttttcaatttaaaagtacctaaagtttcatagtttactattaggatatttattttggaggatcaacgcacccacataagtacataactttaaagcgagtggtaaattttatcaatttaactctttgtgatatgtgatgtgattatgacaaatatacacacaaaatttaagatgattttttttttttaagtatcaaaatgcaatgtttgatattacattttaaaatattttatgtgacatcaaataaccaaatagtacaccaaattaaaaataagccaactataattagtaatgttcatgacttatctgtctcactaactttacccgtagttattaatgattgaactttctgacataatttaatacacaatgttttacctaaattatatttttttacttatttatttttaaaatatattataaatatattttaattgtaattatatattttttatcaagtttgtgatttaattatatataatataaaaattgatgtcattgtcatgttaacaaatcagacaatttcaatcttattctatatattgttaggtctagattaggttggaacttaattcaaatgaaaaattctattaaaatttcatgttgggtagaatcaataacattcaggcactagttaaaagggattgggagattattattcagcacgttcattgtgcgggtaacctatgtgttattctactgataaaaaaaaaaaaaaaaaaaaaaaaccaatgtgttatttagttttctggccaagcaaggatctaatgaactttttatgaattttgtgtgtgtgcaatagcgacagaaaaaaaaaaatccaatagtgtgtttggatctgctcttaaaatccacattttcctacaaatccacgtcaaaatctttaaattgttggagaatctagtatttttagtataaggttacgcatgtttactggtgttaacacccaaccaaacatgcatgcagtagatctttctacatttattctaatatctcactattaggcccaggggtagccacagtgtggttttagatgattttttcatctaaaccagtcgattttgttttcatttagttttgcttaatttttattataactcgaaccaaatcagcttggatcaggttgccggttttaaaaaaaaaaaaaacagattgttcaaaaaaaattaaaagaaaaataatgtataagcaaattagtcttaatgtatgtggagtacaaatggagtttggcttttcaaatgccgaatttccaacgtgtatttttttctttaaaaaataaatacctaatttaattaggtttattttaataactaaatgtattataattaatttttttaaacaattgattagtttatgttttaaaatgtgttagaattgtgaatttaggttaaaatgatgcattattattagtataaaataaaagatcaaattgtatttttttagtgtacaatatttttttaaagtcataggtaaaatattatatagttgtcaatatgataaggacatttttttcttaatatgacttttcatttcaacggagtccacatcttttggatatttccgcatttttggaaaaaatgtactcatttaaaatttcaatatttcccaactctgttactactactagtactacttcttcaacaccatatatggtgcaacaagatgaggcagccatcaatgatcaagaacaacaatggcaatgtagacaacatcctcaactcgtatataacaagcttcctccacaatgtgaggcctgtcaccatttaggatattgattttgatatagtatttatttttaattctgttgtgggaccaatcaatattaatttttatattatttataaatatataattttaatcaagatattagtttttaaggctttctgaaatacaatttgatcattttttataattaaaatgcatgcttttaatacaaaatcttaaatcttaattctaacacattttaaacccctaaaataattgaaataaaaaaattaattataatatatttaattatttaaacaaattattttaatacaactaaattaaattaatgtttaaaatgaaataaaataaaagcatgttcatttgaaaagccgaactctattgataaagcatatacaattaagaagaattaaataagttgctaagtgatctaaaaatacaataattagttgctaagtgattctaaaaatacaataatttgttgctcagaggaactaaaaatagacatcaaaatgacaaaaaattaactccataaagactaatcatgataaacaaataactaaaaataagaaaaaattatatgaattaaaactcgaaatttgaaatactataacaccaaaatcttatttaacccgatttagaatgttgagatttcggtgaatcaaaagtcaatttgggtaccaaaaaattgccaattacctactctgaatattaataaaaaaaaagtattttggtacatattttgggatgggtgtttgggtaaataattttttatgattattaaaacataaaagtcacgcttcgtatttttttaatttttttttaactaattcaagatgttatatcttttctccattttaaagaatttgaataatttctaaaaatattttcaattgaagtttatgaatagttcctctaaatcaaaagaaatcattgggtaagtctattttatttagttatataatttaatttatatttatgttttacaaatttagtatttaaatatatcttggcaaagctagagcatatgtgagcattttgaataaatatttcaaaatttaaatctatgagcattttatattagtattttgattatttagagttacacacatgaatacttgttatttttgggtaaagaagacatgttcttgaatgcttatgcttaacattgccattgtgtataggtataaaatagcaacaaataaacaacgatatcattcaataataagtactacgaatcactgaactctttcagcattattctatgttttccaacaaaaacagagagaaaaaaagactcctaaagcaattgaggttttgaaaatggttgtgacatcataatgaatataaatcaaatgctttgtatcaattggaaatggtagttttaactaaaccaaggaacttgactttcccattgaaattctgctgtgctgctgctttgtgctggcaagacatcaaagtttggttcagcttcaattgttgacaagacattgaagtttgattcagcttttgcctgtgggacttgaagcttttgacaagtaatttgagtttggacatgggcaagtgcaatttctgtactgttgatttgttcatataatttagagataatcccagcacatccataaacagggtcttgagtcctacattgtgcttcaaaatacaaagaatttgcagcttgttcacgtaagtatgatggaatatgctgcaacatcaaaatatacaaaggttatttagtaacataatcttattgactttggatgacatattctaactttgatatattgataattttttccatattatagactaacataaacacattgatatcaaatattattatctatatttaaaacacctgaagcatttttccaacattgctgccaccatagattctgtgaacacaagcaaatctttcaggatcattggcaggaaaatatggaaagaaaatgcaatctgaagggcattttcttctttgattcttgcaagctgcacacctaccagacatcgtgatatcaaatatataaacaaaaagaaaggaaatcaaaggaaaatatttggcatccaagaaagatttcttctcttctatattttgctcgtgtgagagggtggatatcttacataagatttgatgttttagttgccaagagtatttgtatagtagtagagttattaacggctactttttcaatattgcaatgcaaaaggaaagtttttaacaaaagagaaaggaccatgaatcaagacacttagtctatatcacatgaaaattaaaggaaacaagtaatatataacacatatatagaagctaagtaatcaaatacttctaatgtttttgtaaaatatacaccaaataacaaattcgtgtcaaataattactttattattttattttattttcatctcgaatggaaaaataatttttgaataacattatatttttattttgtacttattatattttttaattttccattcaagtgaattaatttttttatccaaatatatctctttgttatttcatatagtgtagcatataaacaattatataaaatttataatatctttgctattaattgttaatttaagtatttgtaataaataaacttcaacttaatatattatatacataaaaaatacagtatgtaaaaattaatttgataaaattaattgttaacaagtaaaatttgaaataactttatgattatgttaatatgaattttaatgttggtatactaaaatatgttttatagaaaaaattaaaacataaggacatattaaatgcataaataatttgaaaataattcatcataattagttgctaagtgcttctaaaaatacaataattagttgctcagaggaactaaaaatagacatcaaaacggcaaaaatttaactccataactaaaaataaggaaaaattataggaattaaaactcgaaatttgaaattctataatgacaaaatcttatttaacccaatttagaatgttgagatttcggtgaatcaaaagtcaatttgggaacggaaaaaatagccaattacctagctactctgaataataataagaaagagtattttggtacatattttgggatgggtgtttgggtaaataattttttatgattattaaaacataaaagtcacgcttcgtattttattttttcaaactttttaactaattcaagatgttatatttttctccattttaaaagaatttgaataatttctaaaaaaaatcaattgaagtttatgaatagtttctctaaatcaaaagaaatcattgagtaagtctattttatttagttatataatttaatttatatttatgttttacaaatttagtatttaaatatcttggcaaagctagagcatatgtgagcattttgaataaatatttcaaaattgaaatctatgagcattttatattagtattttgattatttaaagagttacacacatgaatacttgttatttttgggtaaagaagacatgttcttgaatgcttatgcttaacattgcgattgtgtttaaggtataaaatagcaacaaataaacaacgatattattcaataataagtactacgtacgaatcactgaactctttcagcattattctatgttttccaacaaacacagaaagaaaaaaaagactcctaaagcaattgaggttttgaaaatggctgtgacatcaaagtaattaattaaaacgtttaaatatattttctaaattaatgttttaaattttttaagtaattaacaaaaattcttcacgctataaaagaaaagtctatttatctaaataattatataaaattactttaacaacaataaatactatactaatatttttatgaaatttaatttacttatatttattttccaattttcagatgttatattaacatgtaaatcaatatttaacatctgtaaaattatatcaatataatatatatatatatatatatacgtacatttataaaattactttatactatcaaatgtttaattgcatgctgtaaataatttgtcctaaaaaatttcactgctataaattgcttattctgttttgcacaccccgctactatatataccccaccactacctattcttctcaattcgctcttgctttgtttacaagtcctcctttctcacagattcgtctctccttcaacattagatcttcctagctcatgtttaattcctacttggtctaaaaaattgtgtttgtgaaagtttgagttccaagtttgatgtctctattacacaagaaaaacattttcttttcttttttttcctactttccctacgaattatatgtacttgcatgatgtaaaagaaagattttgttttaatccataaggttgatatagagatgtaatgcttcattgcgttcatatatggaaaaatgatgtatttagtgaaaaaattatattcgatgcaaaaaaaaaattgaatattttattcaacatgcatatatatctcaaacaacgttgtcactggttgaggttgttgctccaaatcatctggtgtcaccatcggctggaaaacatgcccaattacctaccatagtcacaaatgacaaagcaactttcatcatattgaattatacaaagaatttaaaaattttccactattgcaattaatcatgatgataattaattataagttttattaatgattaataataacggttttaaattgcaattgcaatcaattcattaggttagaaactaatctcactcgtgatgcatttatatatgaaaaaatgatgtatttagtggaaaaattgtattcgatgcaaaacaaaattgaattagtaaccattacacaccatgagtgagattagtttctaatctaatgaattgattgcaattgcaatttaaaacctttattattaatcattaataaaacttataattaattatcatcatgattagttgatagcaacgaaatctaacaagtatttgagataaatatgattcattatcatcgtgatggattgataaacgtatgcaaggacctttgatgccttcactaatctggcatgcaccacagggcacagggtaattgtcttcggcaatagcatccacaaagcattccaattgctgaacaaggggaggggcattgtggcgaacgcagtggcctggtgacggtgttgtttgtttataagatatattttatgaaattaataacatattcagataaaaaaatttaatttacttgaatagaacattaaaaaataatttggattctcagttacggagccattgatggtgatggatttaggagggcagacagtggtaccctatacacaggcaattaggttgtgataccatatagaagaaaagaaagatctgaatttattgatgtataagtgaagtacgagtcagtttaatttgttacataaacaactaaaggatatatataacattgttatgcaacagagttattgtttgaacttaaagacaaatgcatagagtttattttttggatcaaagataaactgaagtgcttgtagatattcagagatctagggagagctagttccaacaaacttcacctcacatcccttcatttcttgaatctttaatttcttcacatggccttgtaattcttggaatctccaacattattattagcactgctattgcaagcacctttggtggacgtgccttcttcttctctctttctttcttcttctctctttctttggtcttgtcttctgaggatgctattcaaaatctcagtgtcgtcatcctggaggaatgaaaataagtgaggattcttttgttgttccagtgtaagccaggcacggatacccttcctcaaaaatatatcaaccgaatcaccttctttctttacagctcctcccgaattcttttcctcatttgccattcttatgtatctacgttgcatattagagtttcatttctctactctctctgtacctatatatgagtatacacaaacctaacaaattttacaactaatcaaatatactaatttaaaaaatcaaagcggaaaaactggaatattaccaaatcatccgcagtatatatatattttgatgcgaaattgtcaaataaatttatatttatattttttcttttttttataatcttctacctaatttttttgctgaattgcagtaaaaaaaatattagtgaaaataagtatgcctatatgtcataaagcattccagttgtcaaacaaggggaggggcattctaggtgcgcagcaacatgagcccgtaggagagaaacttggcctggttggaaatcaaggtaagtgctgtaaaaatgactaatattaatacgatcttaaagatatacaatttattacttgttaacaattaattttatcaaattaaatttttacatatggtatttttaacccttaaaataggtccttttatttttaacttaaattagtttaaagttaatggggtttgcttatatagatccactaaaaatattagaagatgatacatgttactactaaaacactttttctgttgaaaaaaaaaaaaattcatgttttatttacaccaacataaattaattaaaggcgggatcatactaactttgaaattgagtcttcatttggagtggaagcttcaactctatatcctgatatgaaatacaccatgtagtttagtaccttaatcagtttaattgtctgggaaacagtcctagttgattttgttttcttggtggaatttgttttctgaataaatggaatcatgtaataacgtggacttgttgggttgtgctcctcaaaggaaccaatatagaaactatgtataagtattctatgataatttttgtacgtgcttgttgatgccatcaattttaattttattttccttatatgaattcagcgtgaaaaaataaatttggatatgtaataaaaaaaaattgaatgagaagggcaacatgttttgcttgatattctcacccagtaatagataatataaaatttatacgttgatatttggttttaccgtcaatagattaggcctttaccgtggtaaatgctttaccgaccttggaagcgcttgcctaaatccaattgccgccaaaactgaattttggtcggttttatcaagaaaagtttattttttactagttcaattcggttcagtttatcatcaattcggggttctttttttgcctagccctacttataggttattgtgttgttactcattttgacctgaagttaaggagatatcgatcttcatgatctgggagctagctaacagaaggaatggtttgaaaggtcttgaaactaatcaagttttgattgaatttgtcttgtatgtcgttggtctaattgttctcaagttaatgttgatcaaacttccgttaacacataatttcatgatatccttaaaatacatacatctgcaatgaattaagaaattatagcttgctaatatttccttacgtatttctcttcctatgtccaaattttattatctgcataatatgtatatgaccatgaaacctgcacagttagcaaacttggtctttatattatgaaaggctaataatcgaaagttagcaaatcacagataaaacaaatctgtcatacctctaaatgcagcacactttacaactctgaattcagcttctaacattatatttttaaccttttcaataatttattgactagaataagtataaagaacatgaataatttcaaaaattagaataaaactagtttaataactaaaactgaataacagaaacggtaaacaaaatataacctcccaaagtaactaaatctaatttgaagattatattttgaaatcatgatcctgccacggatgtattcacaacttgattcttaactagtgcaaaacagagcttagaggagagtctgaaggaccaaagatgcagcgtatcaccaagttttagatcattgtgacacacaatctcgttccatcccttggtcaagttgtagacgtagcttctctccatttcccacttcttgaagcacatgttgtactctctcaaagacggatccaacaccatcactggcatgccagaaagcctcctatttatacctcgacgctcgtttaaggaagactcctcaggtggtgtcagaaatctgttggcaatctttgaaggtgggatcgacaagcgagcttgctgtgggttcaagtctgttttgaaaagttccttctgcgtcacaaactgcacgtcacatccattcaactcttggatcttttcttgaaattcccttggcaatccatcaagttcatcaggtggcccttgctcataacccacatttctttcgtttctagcatcttccctttcttggaagcgatcttgttcttcttcatatgcagtaaataaggccgccactacatctagtaaatattcaaactttgatttgccatgttgtgaagaactagccccttcgcattcgcttttggctctctttgatgggttataattattttctaattctttttcgacttttctttcgagactgatctttgcacccatttcaggatgccgcaggtgcttttcttttgctgcaacaaagtcacgaaccaccgtcttcattggaatagaagctgatgaatcttctccatgcccgaattctttctttccacctgcagtacccattcccaagttgcacttttgcagattataagatttctttctttttctaatgatctcctattatcctccttcacctctctaatatatacacggatgtaaaaagataatcagcaccgtttgccactctaatgtagatataactactctgtaaccgaaagattgtgtaaaaaaacttaataaagataaatcataagataatatataattatgatagtaaaatctgatctaatataatattgtgtagataaggtcacaagataactaaattttattataatgtaatattgtcaagtaaaattatatttatattctttcttttttttataatcttctatctattttttttaattgcattgaaattgaaatatatacaagattgtaattcgaatttagaaaatataatttaaatttcaaaattatatgttttggtgatgtaaagttatagagtattttattttaaataataactttatttaaaacaaataaaacacgttaattttaatcaatcataagattttgttgttattggatttataattttaattttaagaatacaattttaattaagattgataaatattactgtaatattaatattcagagtatttaaaaagatagacatattcagtttgataaaatttatcaaaagtttaaaattaaaattataataacgattaataattttaaaaataaaaattataaataaaaatttaaaattaacaaaaaatttctcaatgtgaaattacatattgttcaaggcataacttgtttaagaaataattgatttatttaaattatgtgttcgtttttataatttaaattatgtatttttttataatattgtttttgtacgtgattagactttttcttagaaaaaaaatattattactaatatattttataaaatatttttggtatatttcaaacttcccgccacaagaatacagatataactgttgtgtaacataaagattgtgtatagaaaacgtaataaagatgaatgataagataattatgatagtaaaatctgatctaatataatattgtgtagataccctcctatagatattgataagataactaaatttactcaaatttaatattgtatattctttcttttattaaatgatgcgaaattatcaagtaaaattatatttatattctttctttttttataatcttctacctaattttttttaattgcattgaaattgaaatatatacaagattgtaatttgaatttagaaaatataatttaaatttcaaaataatttgttttggtgatgtaaagttatagagtattttattttaaataataacttcatttaaaacaaataaaacacgttaattttaatcgatcataagattttgttgttattggatttataattttaattttaagaatacaattttaattaagattgataaatattactgtaatattaatattcagagtatttaaaaagatagacatattcagtttgatacaatttatcaaaagtttaaaattaaaatcacactataattataaataaaattttaaaattaagaaaaaatttctcaaatttgaaattacatattgttcaaggcataacgtgtttaagaaataatttatttatttaaattatgccttcgcttttataatttaaattatgtatttttttataatattgtttgtatacgtgaatagactttttcttataaaaaattattattgctaatatactttataaaatatttctattgatatgattcattagattaagttgataagtaaatatttttattgtttgtaggactttattttcaattgtgagggatagtctgtagccttcacttttgtgacaaactgggactgcaacaatgctgcttcaatcttcaacagttctaccaagtgaagagttattgctttaagagactggttgaccatccaaatgttatcaatatcagttactggagttatggaccagaccaactccatatcgaaacccatgatatatgttcctgtttgccaaccggattcaatcaacaattctaaatgctaatatagattaaggattatatttgtcaaacaataactttaaataggctagttgatcatgttggtatatggtatctattattaacctctttttatttgatacacagtagaattgattgagttttaaattgattttagataaatttcagatattttttcatattaaataggagtttagaattgactgtgaatccaaaattgatggagttgaaacaacttttgatatcttttgcatgggatcaacaaattttatataaagttttattcctaatttataataaaaactttcaaatataaatcatagttttagaattatttttaaccaaaaatcaattttgtcaaaacaatttcactcaaaattaattttgtcaacgctcatctaaacatgcactaagatgtgggtacttggacattccaaaatttgttgtttggttgagaagaggggaagcataatagaaagagaaaaattgtgactcacatgcgaatctcgtacattctactttaattcaaatatctattttttttttccatcttctctgttttcatcctttcaaccaaagacagcataaaatctagactcatttgggtatgacttggtttagcaaaaataattattcattggattaaggaaccttggcttttttgtgttgaaacttctaatggactaaacttccgacattttcttgaaagtgggactcactggtttggtgatccaaaccagcacgtgctaccccatttaacgttacaaatttatgcttctctatcactttaatgactgatagttatattttcagcaagctacccaaatttgtgttggatgttttgagtgtattttggaagtttcaaaggaatcaagtctcacattggcacatttgatcagtttttcacatgcagggttattagagcactgctttcttgtttctatttctgcattttgtatttctggtgtcttctaggatgatatattcacatatagattgtctgaactctgagctgtttctgttagaattggcacacaacttgtcacttgtactattcacaaaggaacgctgttaatagtggtcactacattccccatatcaaggatgaaaaaacactgggcaatggtgggaatttgatgacaagcatgttactaacttgggtttgtcaatccaaactactttaaaattagattagatttaaacttaaactcaacacattaaatgttaaagtaaataactactgataagattagatcagaatttttctcttcaaaactaatttcaattcatctaatctgcaatcacccttacataacccggcatgactccacgtggttgtcatcagacatggcactaaccacaaaccgtaggccaaccaatatcgcttcaagaagaaaacgaagggctagaaatcataaccagcaacaaaaatatttcgccttttggcacccaataaatatttcatcagtgaaagtgcaattcttaagaaaggacaccggatgacgggatgaggatttcaatttaacaaactgtagaatctaacttggaaaaccaccttccctaggcaagtccatttattattagtgtgcctaataaattacatgtggactcaataataaacttcaaagtgaaaaggaaaccaaaaagagaaataagagttgaccacaagtcacgcggagcatgtaactcaaaacaaatctaaactacaagctttacatgtctaagatgaatattaactcttggaagcctttatctgaagcaagcacccatcttggctgcaggacacacaatctagagacatcagaatagcttgccttgttgttgggttccactcctcatcatggtacaaaattcttcatagttgattctaccatcctgagaaaccacaaaattgagtgtcaactatggatagaactagagtacaaaattgtagtaagcaaaaagaaaaacaggcttacattatctgcgtcaacttcggatataatttccctgattgtggcctcgtcacccataccatactccttcatggctgtttccagttcatctcttgtgatatacctgtgatggaatcaaacaaaaatcagggtgcatgtgtcattactctttaaattctaaatagagctattcattatttaatgattctgtaatgtatgtgcttttgggtgtaggaagaaataggatttatggtatatgatcttgttaaatacttattaaaaaaactgaaaacataatccgatagtcaaaagattaatatggaaggcatggacttcaaaattgaggttgagaatgcatagtaggaaaaaagaattacttccataatgtgacagattgaggaagaaatgttaattcacagtagatggatttacccgctgtcgtctttgtcaaaatattggaaggccttgtaaagatgctcatctctttctaacctgtgtctatgcattgtagcagtgatgaattctatgtagtcaattgtgccatttccatctacatcagcctaaatttaagcaaaggagtgtaagcttgaaagaatatagaaaaagcaaaggagggcaaatcttgtgaattcaacaatagcttacggcatccataagctgtcgcacttcagcttcagtaagctttgagcctagtctttgcaatcctgccctcagttcctcataggtgattgtaccactattgtcagtatcaatatttgtgaacattgcctttaaaccttggatctcttcttcagaaagattttcagcaatgacctaaaacgattatttaagtccactcagtttatttttgaattggtagagatatgtacccctacaccctatagttacacacagtcgagcaatttaaagtcattatgagaacactggaaaaaaaattatgtctctcaatgtttaattatgccatcaaatacaataagcataaaagagcattgtggtcacttcatgcagcttgtggcttgactaaccttgagggctagtttttttagtttattcattgctctgaattgcttcattctggaaagcactgcactgtctattggcttgtcagaagcatttccaccttctttaagccatgggtgctctaaatatttaaacaatacaaggaatcaattagtaaagaaaatataattcatgaaccaaaaaattcttaaggatgctgcaatcaagctatcagtcagcagtaatattaacgggaaacagttttgagtcactgcatcaagacaaagacacacactgttactagcttccctcgtgttcaataatgtttcattttctatcacatacagaatgtcctataactaaacaactgacatgtttaaaggatagataatagaagaaacagtatatttgtgaaaatattgtctctgaaaagtccctagtctcagcaactaacatgttcaaatgcatcattggttgtcgttgtcacacctatatgggtatagaataatctatacagatggaaagatcttggcacgtataagtttttaagccctaaattcagtttttatatgcaacattactattagtaataactatatccactagccttgttatgtgttagatagaagtgaagggaaaattagttgggaactagagtaattagttggaggggatcaattagataaatatggtgaagggtgaaactgtgaaaggattcattcagagaattaacaagcttgtaagaaagggggaatccttagaggagaatccatgtttcggttcgttttcattcaataaataaaatcaatctttgggttgctaacagaactggaatatatctaagcccctttagtgatctatcttctcaacctcacccaagtacacacataaaaggatcaagtaggaaagaaattcaaactatcaatgaggagaaaacacaataaaagtctcctacctagaacctgagcagcagtaatgcgtttctttggatcctttataagcattttgcgaacaaggtctttagcactgtttgatatgcttggccatggattactttcaaaatcaatatgaccttgcaatatggcatcaaatattcccttttccgtctctacatcacatattttattaaaaaatagtcaactgtaaaacagggggaggctagcctctaatacaaggaaattatcctattatcaacatatcaaactcagagtttacctgcccaaaatggtggtacgccgctaagtaagatatacaatataactccggcactccatatatctgcttccttcccatagctacgacgtagaacttctggagcaacatagtaagcactgccaactatatctcgatacacctttcctgtgaagaataaagaattaatagaaaaaacttagtatgttttatacaagtgagatgatgtataaaataagtaagcgaggtttatcaaccgtcaatttcgtaaacttaatttactttaaattaacagtagataaaccctttctaacaagccatcactttacaatttccatctccatacttgcaaaaaaattaattcataaatcatggcacaaattgagtggcaaagatgtccatctactgaaatgtgataaagtgcatgcatagatatggagaaaaaagaaaaaggagataaagctttagaaaaattagttggcagaagtttattcaaataaacatcttgagggagaaaaaaaatatcccatgaaacaaattaaaagctactcaaactttgcaagtcttgacaatcaggccattgatgtcaagcattggcaatgcactattagaacttaatagaaaaatcattttcaatcttacatgccttttgcatccaattcccccccccccccctccccttacacaaacacacacaaaaaaaacaaaaaaaaaaaatggatggaaattatacaaaattttcctcaaaaactttagaagattattcacaactatgctacagttcacatacttacctttcaggaatccccacaactattaaaaattcataagaaaagaccaatgaatggataacaaaatataccttcttcaatgaagactgacaagccaaaatctgtggccttgagatgtcccttgtcatccttactggatagcaagaaattctctggcttgagatccctatgaatgacacccataaaatggcaggtgttaacaaccttaacaatctgtctacatattgaagcagcagccctttcactgtagtggcccttggcaataatcctgtcaaaaagttcacctccagcacacagctccataaccacatgaactgattgtttatcctcaaaagcacctttgaactccacaatgttggactgtccactcaaatgctgcatgatttgaatctccctcttcatgtcctccttgtcagctctgctcacaagcttcctccttgaaatggacttgcaggcatactgcaggccagttgaattctcagtgcagagataagtaaccccaaattggcctctccccaattccttcccaagtgtgaagtgctgctttacatcctcaaatggcttcccagtgattgtgtcatgcttgtgaacatgttttgggcttggtggaggcctccagggtgcctgaggaggagcatgtttctcatgtaattggtatggttggtgagaagggggtttggtttgggtggcaaagggttcatggctcttgtgattgttgtacacaccagcacccccagcaccggcaacatgtctgtaaccaatgtgttcttctggctctgacccttttttactcagacaacaacccatggttctgacaccaaaagggaagagattttttaagttttatcaggtaccaccacacaaccaactacttgaaagtgtgaagattcagtcaaagaatgaaaaagggaatgaacccagaagagaattcaagaaagaatatccattgaagtgtgaagagagagaaaagggggggaggggggaggagaagacaaaggttgatgcagaatggatcagaatatgtggttttttaaaggaggagaggaaagtagaaagaaagagtctcaacaaaaaggataaagatagaaccgagtcaactgtgggattcggattttaacgagttaactaaaaaagggttgaaactattttacgaccaaaacaaggttagagccttggagggagtccatataatagaagaaaaacttccttgattcattctttcttatgattcaaggaccgaatcagagatgcgtatccaacaccacatttttctcctgattcgttcaccacatgctgccacctaatttttgttaatgagtaaccaaaaaaaaattatttagtctaaggtttttgtttttgtattttttatgttcttcaaggactaaggtgatgctgctctcatgttcgtatttggatagacttttgcatttccaataagcgtaatgaaaaaatttatctgagatagtataagcttcgcacttaagatcattgtgtcaagagaaaagaaccattgataaaagaatgttgaaaaatatatttgtaaattaaccaaatcattaaatagctgtggaggtcagaataaataaaaaaacgctatggagatactatgtgtgtatcttagtatgtgcacaattctatggattcaaaatcaaattttataattttcataaatagcattatagattccttatagatcataaaaatatataatcataaataatattgctcatatctctttattttggcaattacattattggaaatcattaattattaatttaatacaatattatattttcatgtgcgtctattatataaaggttgacttaaatgatccttaatttaacaaaaaaggaaatgtgtgcaatacacttaattcttttgaagttgaaaatcttctaaaattaaattaacatacatctttaagtagaaatcaacaattcctcaaattgaatcctgcgtaagaactcaggatcagcatgccactctggggtcttcaatgaaaaaattatgcttccttcgataaagtgtgagacattattctaataatttagacgttacatttatttgtaagtgttttattttattttccaataaaaataattctcatgaagtcatactaaaaaattgttttggttgtagagcattttctcaatattaaaaaaatgacaagtgtgccgagaaattattattattgttataaaatgtgtttttggttcctgaaattttagtcaaaattaaccttaaatcattttaaaattgtgattttcatctttaaatatttgatcaaaattagatttagttttttttttttttaaaaaaaggtttttaatgtcacatggcaaacatatgatatccatatgatcgttattagtcatgccaacaaaatattaataaagttaggatgagagactgaattcacctattttaaaaaaattcaagaaataaaaccaaattcaatgaatttttggagagcctaaattatatatttaactcttttattttcatttaaattgtcaatcaattaaaacaacataattaacaagtaataagaaaacaaaacaaaaaccataaaggatagaaacacttctcctaactttaggtttaaatagagtttatctcgttagttttcatacgtttaggttcatcttccatgtttgtctcccatgtttgtacggaccttttgtcatcttttaatacattttaaggctagctggtttagttagattattaaggtgtcaacataattgaaatgtcaatatctagttatagttagtctctattttacctcaaaaaataaaacaaaaactagcattttagatgaaatattatacaagctaaatttgtattagataaatatttattcttataaaattataatttataataaaaaaatatttataatttattaagtgtattataactaaattataataaataaatactttttaatatataattacattttaaaattatattgaataatttaaattatctttgaaaaacatattaaaatccacacaactcccccttctaattagagcatatttaatgtacatattttgatgggtatcttatattctaagatacagtatcaataagaggtaattttttctgtttgaaataagaagaaaacaaagaaaaaaaacaagtgtgaatcttgcttcaatttttttccctcccataagaggaagtgtgatggaagaatagggaaaaaaattcaaaaaataatccttgcaatgcattttatttttataatatttatgaagaaaaaatatatttattttttaaaaaaatcaaataaaattaatgaattccttttcttttcttttttattcatttttttctcttgttttttctccttcgccgaatatgctaatcacaaataaaagaaatctactcgtaactaaaagagaaaaataatgtgcttgatgacggtgatatgatggaaattaattggaaaaatatgatcatcaaatgaaataggacacatgtgaaatgtaaatcatgaaacgtggacacgagacaatatataattattatcatttgcgtagtagttaactctgaagcaagaaaacgtgtacacgagcaagcaactcattcacggtttttatttcattcaaatcatacactttctggtcaaattctcagacccccaacagattctatgtttcaattaaaataattctcgcacttttgctttattagaaacactgagtaaagaaattaacgtgagagaacacaatctaagcgtttcctaactttccttgcactttatttaatagaagtgaaataggtaaaaaaaaaaaaatgtcaagagagatgaaattagatggaaaattaaaaaaagttgaattatttgattaagtttaattaataaggagagaaattaaaaaattgtaggcgcgccacactaaaaaatattttcatgctaaaatgataagaaatggaaggaaaatatacacaatacgcgttgctttaaggaacacttcaaataaaatcctactttataatttttaaactataaaatgtttttttcatccacagtaatagaaggtgatattaaaagatttatcataactcataaatcttactcaaataattgaactagactttcttaataaatgattttatcaagttttagtttttatgtactaaattaattaaatcatagctctgaataacaatttattgggactttaaatctaactactacattgaccgtgttaacttgatatttcttaattttgaagtaattattactttaacaggaaaaaaaaaattatttgtcagtatacaacattatgaaaatgtttagttttcaagtttttctttgtaaataatacttagggtatttttttatggaattatcttgtatttttagaaattacgttcccataaatttgtagtgaggaatgttattcctaagcatatataaaaatatgtttggttaacttttaacatttctaataatatttaaggcaatttttgtttttcttctaaacgaatatgatatcgagattttttattggagcgtgattggtttttttcagattaataaatgataaataaaagtcaatttggagctttctcatcccattagaatgggaagaaaagttgtagacataggaatgtaactttcttgagaaaaaaaagaagctacctttgtagtttattctttagcttgtaattcaatagagaatctcaaacactattattttattttgtgcccagttttacagtttttgggaataaaagatattcatgaatattttctgataatttcttattaaatatgggaataaacattctcacctttatatttatgaaaatgtaagataattttgtaaaacaaatgttattctctattaattctttatctcctttttgtaggattaatttttgtattgataattgtaaattaagttatttgttagatgaataattattgaggtaaaagagaaatacacacaaagaactataattgtccgatgctaaagatgatgatacacaaaccatggacctaatcacataaagccttaaaaaatggagcacgtttttttggatactaaagatgaatttactttcacatatctttttgggtaaagcaaatgggtatgccctttcttccccctcccggcctcctcatttttgggttaattatttacaaagtggttttgcttttcttaattcttctgtgacaataataaagctatgtttaagtttttgaagctacaaaagaacttagctttcaagtcacaattaactttcctagcccgcttggctagttgagttgctaaagcaacctttattttgtggagatgccgattttattttgttgtgttataattttggttggatgaatacttgagtgtcgttatgtacatgtttagggtttctttaattaaggggaaaaaacaaaatcttaattagtattattttttaaatcgtcaaaattataaataaaaaaaatcttaacaaaaacatacttatgttaattactatgtttataaaaggcaagcaaaagaccaaggctgcaatgtctttgtagagctatggcccatgaatctaccctatgtaatgggagcaaatttgtggctgaagtgagtctgttaaaagtgatacaaattaagggacagtgatatttcctcccttgtcttatacaaatctttttgctaactaacatgccataagttgactatttagcatttcacatgctattctattttgataacttccaagaaaattgccattattgattgaaggttagtgtttattttttaacaattattaattgttattttgttaattttattattattgagagaaatttgaatccataattattttttctctctatcattattttgtactgccagaagtaattattttattaaaaataacaatataaattaaccaaatcatgagaaaaattatcataatatatttattgggtgtatacatctagtgaaagataaatgtataaaataaaaatctagtgaaagataaaaaaaaaatacgtaaagagaagtaaaaattataaggagtgatgtaatgttatataagaaaaagagaggtacggtagagaaataaagaaaaaataaattaaaaaaagtgtaaaattagcaatattgttaaaaatcaaaatcataatcaacaatgagaaatcacacttttgttttttggaatctttcatttcactttaaaatatcttttcagctaagtgctaatagctaatggctaataacctaatacaaacgtgtaacacatttacccaaaaaacatgtggcacttcacctgatcttgagaaattgttaggagtttgtaaaagtggttattattttattagtttgtaatatttgttgaaatgttattttatgaacgtttaagctcataggtttctaattctttgaagaaaaaaaaaaagttattttcatttttatctttattatattatgataactcttctaatattgacaaaatgttgatactttctcttattctcattaaatatcatttctttaaaagataaaattattaaaattataatataacattatttatattagttcattacattaaatacaaaaaaataaaataaaaaataagaataaaattaacgtactagttatgatgtggtgcgaatatatatatcatggggctacgtgtgcaagagaagataaattaaacggcatagtaagattaattgaagaaattaaaaagaataaaacaacaattttattcctacattattattgtttctgctaaatagttcctaaagtaaagaaattatataactaatccctcaggtattaaaaattgtattacataattcccaattataaaaaatatttcaaattaattcttggacgttagtaaaacatgttaatatatggaataaatttatgctaattcaatattctaaggattatttatataatttcattagttcaaggactatttagaagagagaatgatacttgaaagactgaattataggtttactgaaataaaagaagaagaaaaacacaacgaaacataaccaataacaaaaatgcttcttctactaaacaggcaggtatatatattgaactttttgattgggccaatagaacttaaaatttcagttgtgaacccaaaaaaggcccaaaaccatcttttaaacaacctaaacacattttatgtaaggtatgaaaagactgataacaaatttcagttgggacaataattttgatgatcaaaacgcaatagtagtaacacatttaatttctgataatatcgtggaagtgaggaatgaagttgccacttctcaactccccagaaatacgaaaatcttgtcctggaatagtgtgataaatatatggttgccacaacaatatacaattaaactgattttttaacacagaaatagacaacagtgaatatatgatgtcacatcaataataaataagtaaataaaatatgtaagaaataaataaccagttttaaaactaaattaatgagcggaaaataaagctaaactctgaagttttcatctcccactcccattctccctcgtagtcgtaggtctttctattccttactctcattttcaatttataacaattgtcaatattcctattccaaatcaatgattggctaattaagattaaagtcagtaaccctctccttctttctgttttggcagttgatacgtgaaaatgaataaacgcatagcttcaccatccataggtggaagatctctgtgctaacatatgttttcattgctcttacttttttgaatgaaggcctcatttgattgattgattaaatccatacaacatgtgattaattaataggacataaatattgataaaaagagaaaggctcgtttttttatcaaatcaaaattcattttaattcagtgcaagactcattaattatatatttatttttgaaaaaattaatcatttaatccaaactttaccttttattttctatatataaaaccaatatttttagtctttatacaagtattttcatattgtagttgtcgttataaatagcaatgactaaaaaataaagtttgtataatggcagggactaagagagatttgaaagtatttgtgcaaagataaaacgatatgatttttaagtatagagattaaaggataaaatttatgtaactacaaacaataaataagtaatttttcattattttttatgagttcctttctttaatatgtttaacaagtattttaacttaatttttaatttttttattagttaaaaaatgtttgcttgatcgcattaatagtctttggtaaacaaacttattttaataaaatataacattttgatttttaccttcttatattttatcatttttattccaaaatatttattaaatttactttattatctttttctacatatcataagatagggttttattattatttttccttccatctccacatccaatattgtgattgacgtcatctttataaattataattataattcctaaaaatactttttattcaaagtaaacttaaaatatgtaaaaaaaaagtctactaaaatagaatttttgccccttatctttatatagataactttcaaattcagatgtggagtgttttctctgcattaatatatataaagatattatgtatcatttaatttaatcgatagattagatatgttcagttctttaaatcaaaattcgagacttaaattaaattgatcaaattttatttttttcaatttgaaccaaaataatgatttaaatcaatttgagtttttttatactaaaattagttaaaatttattgaattggggagttgatgaccatcctaccatgtagtacatatggagtttgtatagtgaaaagacaaaagataaatagtgtgttttctaggctttaaatcagatatggaatgtttttttttactaaaatgaattaaaatttctgtgatgtattcaattgtaaatagtaatctattaaagttattgccaaattagagcgtgttaactatgcttttttttataaagaaattaattactcaacttatcattttaaactttttaaaataatttatataataaaaaagacagttattgaggtcagcccaatcccttacctaaaaactttataagacgaaaaaaaaaaaaaaagaggtcgacccaatggtaaaggctattaataaaatttacctctgccaattactctatttacctctctttttctttttcttttttattttgttattcaaaatacccttttgtatcccatttttccagtgagggtcaacaacgtgaacaatttccagaatcgtccacctgaacaagttcggaatggcaatgcatgatgatgaggaccatgcatagaataacaaaataatacaattaactctaatcctatttaatatttaatacacattagataacaaataaaataaattattgttatacaaaattattattttatttatatagctacttttcttaaaattataaaaaaataagatttttaaaattataattatatataaaatatataaattataatatacatattgagggagagagactttatcctatcttcttattactggaagaagcttatatcatttgattctaaataagagtctcaatacaagttgcactaaaataaaataaaaatatatattaactggcatgaaatcttaacaacatacactttagcaaaataatgagtaacataattcgtttctcttctaatgtaattaacagaatagttgttaatatagaataaactgtctctacacttgagaagaatggaaccaaattcagtttgtacatattaatttttttattgtgcacacacacacaatatatatatatatatatattaataaaaaaaagtaggacgaagaggagagaggtgttaaacttttccaattaaaaaaatatacttttaaatgagaataaataataaaacgaaacttaaaaaaaaaaaaaaaatagaaaactgaaatagtagaatatttactttaaatgaaaattttaccttcctttatttttatctgaaattatcatattaggatcttattatttactttttattcttatattcgataaaaaaaatcaaattattttttaactaataaatgtgaaaaaaattataaaaatctaaaaaaaaaatttaaggtatcttttcatgaataaattaggaagaagagaaaatagatgttaaatttatatttacaaataaaaaataatttattttgttaaagaaaataataaataaagggaaagctatataatattttattttgaaataaatcataataaaatatttatttaaaatttaattattttatcttcctttatattttatttataattatcactaggattttattatttactttttattctatgctttcatataaccttttaatttttttaactaattaatgtgaatgaataaaaaaaattataacaatctaaaaaaaaaattacctatcttttcatgaagaatctaggaggaaaaggaaagacaaattaaaattttatttaacaacaaaaaaattatttttaagagagaataaggaataacaggaaagttatctaatattgtaaaaatatatattaattaatataatatttactttgaattaaaatttcgcctttcctttttatctaaatttattctaggatcgtagaaattacttgattttgttccaatgcttttacatatagcaaacttaaaaaagtttaactattaataacattaaacgaatggttttctaacaatctaaaaacaaagcgttgttgcatctatttatgaaaaaattaggaggaaaaggaaagagctgttaaatttttatttatagataaaaaataaattattttccacaaacaagcaagaaaaatggaaaagtgatatgataatttttataaaaaaatctcaagtaatagaatattttctgtaaataaaaattatgccttccttcctttcttatccaaaattattactaggatcttataatctgcattttgttcctattcattcatagcaaacttttaaataatttattaactagttaatgtgaataaataaaatatcgttaacaatctaaaaacaagtatttgaggtatcttttggtgaagacatcaagaggaaaatgaaagagatgttaaatttttatttataaataaagcaatttattttctaaaagagaataagaaataatgggaaagatatattttttcttgaaaataaaaactctaataagagaatatccttaaatgaaaatttcaactttctttttttatccaaaattatcactagggtcctattatttactttatatttctatgcttttatagcaatttttaaattgttttttatttattcaacgtcaataaattaaatactttattgaacaatatatcagtttctttgaaaatattagagaatatctatttgacgaagttataagattaattgaatgacttctcaattaatatgttatatgaaccctcccgaaacaaaaaccatttatcttatgattttattgtataaattgatcatatatatcactcatgattgtaaccaacgtccaacttatcatatgataattactcattgatttttacattctaaaatcactttgaccataatattataggagttgtccgctctatataataatccattgattactacgttctaaacccactttgcccacagtattgtaagagttgtttgctttatataataatgtttattctttgaggtttcaaaattgatagagcaattttgagatgattggatctcctttttgaggatgatactctttctccctcttgccttaacactttctctgccacatgaagacggtacccaaagccattggttggatatcacctaaccctaatgcatctttgcctcacctcaactcatccttgttacaaccttgctcttgtgcagagcaaagttggattttgatgcatcttcaccataaccttggttttacatggagagatattttagatttagtgtttatagtgttactcgattaaaccttttacactttatccttcaatttggtgtttgttgttaccatggttgttgaaatcaagatcttatctaggattgagtggggaaaaatgtgatttggatcataagatcctacatttctttcctaaaatacttataaataatatataacttttatttttctttaatttcttatatcatatattatgttttttagtttatcatattattatattctttgttatgttttattttttgttaattacacttataatactattatatttcttcttattcttcttctttatttattatattatatgtaatattttacattttaaaaaaactaaattggactttaattaaggcccaaaaatcaaatatgaaaaataaaataaagaaaaaatttggcccaattcccttgaaaccctacgacctacatgtttctcctataaatgctaagtgtcatcagccactgctgtaaaagtccaagaacaagtgcaaccctaattccttatggtagacagagagcgtagatagaagagtactaggaggttagcgactgtaagaacagaggttgtttggcaacaacacaacaacaacgacacgaaagagtccccacaaagctcgcaaaatacctttatttgctcacctaaattgtttagataggattgtatatcccacatgaaagagtgcaaatttaatctgatctcgcactccaacgatcctaacgacgatgcaacacagagatgtcttcaaaaatcgttgaatcgcacgttcctacaatctggattgtgattctaatagcattggctactgcaccagatagagcagtgattgtgggtgacagttgttgcttcagtgcaatttggatctggatctcacttcttgacttcaacacttcatcaagcaattctatattgaggtaacactattttgataactcaactatatactttaaatttcccatcttttattccatgtattgtatttttcatttaggtaatctattgcttttgagcgattgttttatttatatttttttggtgttttgacttcagcggatacttttttgtgttgatttgattgggatttttggagcattgtttgtttttgcattgatcttatgcatgttgtgacacaaaatggaatgcagttataggcagtagttggtgcctcgatggaggtgtggatctcagtatgcctctccttcacacttgctagggtttccttccatcacatcttgcaactttgtcacacaattctcaatggaggtaacatcgtttcgataacttaattgtgtacaaaatttccattttttgttccacgccttgtctttttcattttggaattctattgcgtctcggtaattgtttgacttttgttgtgtttttggcttcaacaaatccttttgtgttgattcaattagtatttttttggagcattgtttgtttttctattgattgagtgattgttgcaacacaagatggaacaattattcgaacgatggttgataccttagtggtagagtggatctggactgcctctccctcactccatcttccatgcacccactaggtttcccttccatcacacatagatttggcaatttcatcgtgcaattctctgtagaggtaacactatttgatactcaattgtcttttttccattcttgtctttttcatttaggtaatatattatttttgactgattgattgatttttgttgtgttttggttttaataggtttttttttctgttgattcaatttggactttgtttgaagagttgttgtttgttttgtgctttggtttagatttctggtgtgagagaattttgctttggaaattggcacgtattacatcgattctatttagaaatgatgtaaaaaaattacatccattctaacataattaatttgaaaaattctaacattttacattagctgattcgtatagcaatatagaaaaccccaaataatcgacataataagggagatgtagtagtgtaactgtgtgtgtaatctaagagcgtatttagtgaaaatattttataggataaaataataaatattgatatttaaattacatatgtaaataaagctaaagaagcatgtcttttaaatctaatgctagatatacattgtatgataatgccatatataatgttaagttatgtcttagtttatatatatggtttggattaataaaataattgtgtatgaaaatgaataagagcatacaaagaggaggatgagtggcaaaatcattgctttggaccaaaaaggaaggagaaggaaagccatattgaatcagccaaccatggcataaaaaacaaaggaaaaagatatgaaaccattgatttagctgaattggtcttcagattagaatatgactctgaataagataatgacaagtatgatgagtcatgttgtcaaaccaagactaagaacaaacccaactacagaacactcaagaagctaatgccattaacttggataggtttcataagttgatgatttcattttcttaattgttttgtaattgggtctctttctggtcttgatttggtgaatatggctcatcatccttatcatcatcagattcagagtcaaattttaatatgaagaccaatttagctatatcaaaggtttcatctcttttttctttatttttcatgtcatggttgactgattcaatatatctttccttctccttccttttttggtccacaacaatgattatgctactcatccttttctttgtatgttctgattctgtttcacacacaattgttttattaatccaaaccatatatataaattattgcatgactcaacattatgtacaacattgttttattttttgttattaaatttattaaatatcttcaccttacttctcattcctttttttttttaacctttctcaattatgtactataaaatagaaaggcttgaaggagaaaggattgagagataagagatctggatatttaagtaaatttaataaaaaaaaaaaaagtatatctaatatttatgggagatatgtttaacaattgcctatagtctttttgaaaactaaaaaaaagtgcgaacttagagaaaagatgtatgtaaataacatgggccaatcaaaactgttattagggtgaaggatgggcccagcccatgaacccttggagcccatccattttaagggaccaaaatggtaaatgagtgcctgagataagggtagttttggtaaaaagaagtgactgttgcagcaaagacccccaaaaacaaactccaaggttgaagactttgacagagtgagagtgtaaggtagagtcagtcagagatatagaaatggcgtcgtggtgcggtgctcgtagcttccagattccggcgatggaaggcagcgcactgcgcaaccgtgcttcattggccgccggagtagggtgtttgtcggtggtcggcacctccttctggcgctcctcttcgtcaccgaggcactctttgccattcacatgcttgagcatttcttccgaaactcgtaagtacccattatgaagaaaccttcaaatttttaaacttttacttttttgttataatggtgatccttattgtttgtaggtattaagaaagtgttcaaaccgaaggggcacctgcggctctgggaccatattctcaagcaatcaaatccaacaaccttctttttgtgtctggtgttcttggccttgttcccgaggttttttaattcacttaattgttatcacttcctttaatttatgatgttcgtttcttcagattgttgatgtgtgttttgctcttcaatgcagaccgggaagttcgtatctgatgatgttgaagaccaaactgaacaggtacagaatgagacaacattttgtcttgtgatattacattctttgaatgtcaattgttgtattgtatgatggtaacattttattgatgttgcaatgcacttgttgattttgttgctgacatttgatataattaccctttgtagcttcttaaaaacatgggggaaattcttaaagccggtggtgctagttactcgtcggtcgttaagacgacaattatgtatgaattcctcactcatttgtggttggggtttattgcgtttcagcaagattactagtttttgagtttttatttcctgcaggttggctgacttgaaggacttcaagaaagttaatgagatctatgctaaatgtgagttctgtggtattgattttaatttttaatgtttccttgacagttacattcttgtagaaggcgaagcttgcactaacttgtttagtgtgaatccatttcatattgcagatcatgaaagtcctgtattgacaaactgcttaactgtgctaattactaatgaatttcacttctgataataatttgtactgtgctgtaaaaattgatcctgctgcatttgtgggctgagaatgtgttagcctgtaggtaacatacatgtaccatggctgaccactgaccagcttttagattcaaaaccttcatgcttttttatgatttagtcttgaagattcacctgttagcttgtcataataggtaataggttatgttgtcaacttgtcatatttaatatatactaagggtgattactagattgatactagagagtccactagtagcatgctgaaaatattaaggttttccctttgggttggtattatttaattttcactaatgcctacagttacttaaataattttaatttacctacttttccaatgatttcagacttcccttcacctttccctgctcgttcaacttatcaagtagccgcattgccattggatgccaagattgaaattgagtgcatagcaactctataagcatcaattgtactagtacatctggctccatcagcaaactcaggttaataatgcaggaagggacatatcttagtattgaagttttacttagttttgttctttggataatggtgctcttgtgattacatttaccatccaagcgaggtctctaatcttcggattctctctcaaagattatgcatctatttaagtgaaagaaacttagtcattggatgtttcttgtttgcagcttttgtgacatcgtatacataagacagaccatgaataagatcatttttaataaatatttttactcgaactcacatctattttctttagattgatttgtggacgttacattgaaaaccttatagtacgtactgattatcttctttttcttcatattttgttctttaactaaagatatcatttggctgatggttagatatgaattccttttgaggtactatataagtcactgaaatggattgaccaattcataaatataagtaacagaaaaagtaaccatatacaattagtaaagattgtttattaattaaacgacagagataaacccgtttcacttctctccctaaaatgagaaggtttactttagaagatcctgatccttgattagtatccgttagtaacttgtttttccaattcaatcttttgtaattttgtttaattatcatttgattagttatacttaaatttctctaccgatattataaattagtttgcattttattaatttaggtttttttttcccaaggtataatattacatttccaaaaatcttatccccaagaatactatgcttacggatgaattttcataaacatgtttgatttggttggcatttaataattttagaaaaatatttaattaaaattttgaagaagaaaaagtagaggaaaaatgtggaagaaactcaagaaagaagtaggaatatggagttattttagaaaagaacttttattttcatgaaaatgttttatattcctaagaatcaaccatacgtggatatatttttttttatatataaaaaaatgaagtaaacttgagattgtgacattcccaaattcacttttctgaaaataatttgtgaaatcttaaatcaaatccaaccttaatatttaagctgttatgtttttttctataatttttccttaatttcttgtgttaacaattctggcttccctaaccaagtttatgaagcaaccttagatattgaaaatgtgtaacttgttttcattgaaaagagggaaagaattcaatctgagttgaacgatttagagcatatttgactaaatgttggtgaagaagaacgtaaatttgtcaacttatcatgattctttcttttatattggaatgttggatttgtctcaaaattggtaagacaataatttgaacggaaaattaaacatgcactcaattattcaaactatcgacaaacatttgtcgatttttgccagttttcaagaataaagataaaacgtaaaacatctttaacagtgaaactataacttttctccctctatcaaagtctgaaaaaaaaaggaaataaaaaaatataacgggcttgcttttttaattaaccaacattacttttttaagtaaccgtaattatacatagatgttatttttaaaaaaatattaaggtaagtgacgaacattaaagttattcataaagttgcctttctcataattatataactctatcgtgtcaatttgtacagtatttagatagaattttctatccatacttataacagaaggaaataaaaataaaataaatcatatttatattctgtaagcaaaatcgatttatagttttcaactttaattatgaaggaactaaataaaagagctttttataaaagttaaacagtgtaaatactatgtttggtaaaattagaataagctaattgacttaatgtttgataagattaattgataaatatcaaatgtaaaaaatatatttagtatttttaatatttaaattttatttttaataatttatcatcttaaaaagtaagatagtaatttttaaaattttgtattataaaaaaatgatttttttaaaagtaacattaaataaaataaactttattagaattctcttgtttaaaatcattttttaacatttaaatactttattaataatattattttaaaacaaaaaatgaaaagtgttttttataatttttcttatatattcatttgataagaagaacttagatgtgtatgtttctcacttgaaagactatgaaatattatacaaatcatatattgtttagcaaggtaagggttttttaaattgaattaaaaggtaaaataaaataggaatgataaaattaagaagaaaaaattaatagcttataagttatcttatttttgataaactatttcaaataacttatcaaaataagctatttaaagtagtttatgaaaaataagctattaaaataaattaatgtaccaataaacttattttagttaaaggaacttatacgttatttaaaaaatttataagttccttaaatgtcttatcaatcataatcaattattctaattatatatatatatatatatatatatatatatatatatatataagagctcattttattctcttataaattataaatacatattaaaaaattattcaaacaagaagatttatttgctgatactttctcaagaatacattgcataaaaaatgtggttccacggctagactatcaccctttcttgcgagttgcgaggattaattcccatcatcggtaacaaaacaaatataaaattacctgttaagaggagaaaatactatttcaattaaagataaagtatgttatgaattaattttgatggattttggacgaacgaaatgagagggtcagctacccagaaattttcataatattcaggtttgattagggttcataggaaagagcctttccgatatttgaaagaaaattaccattaagtacatgagtaaactatattacaaaacaataattagtgttttttagccgtataaaataaatagttttacttgctgaataaattaatttgtaagctctatggaggccttgtcatcttaatacaaaatgagtattaaaagatccattcaatatactttgcaatttccatgtcatcatcttgaaaggattctattatatcctacgcttttatccgatgaacatgctcctttttttctacgcactgattcttttatggttggggaggggattttgattatctctacgcttgaaaaggatttcatcttcatgcgtgcatatgcttttattcaaagaaagcatgcacttttttttgtacgtattgattctttttttcttcttcatgtgagtgagggttttttttttttttgattttatttttttttttatgtgagtgagggtggggtggggggataatttacccattgattgttctgcattgcataacattagagtgtgttagagaatatatatttagttgttgtgtaattgagagaataaatataaaaaaattatatcaataaatcataaataatcatataagaatgtatttttttttacaaacaacccataaaaatgtattaaagagtgtatttggaggatttctccatctattagtatgacaaaaattttgatgacatctcataagatacatacgaagaaattaaatgatatttgttactatttattgattatttaaaaaattcttcccgcaaaaaatataaaatattaaaatattaaaataaataattgtatttttaattcaataattattttaatttatgagtatttgtttgaaaatgcgaatttatccaagtgattaaagatttataatttttaccttctttatgagtgagttccaatttttctaaggtcactttttcaatttttccacttgtgtatgtgtgcgatcctctctgggaaatcccccgatacctattggagtgtcttaccattgtaccatttacagtgtcaaaaaaatatatccatgcattgtaatgaacacttgatttatacttagtgttttatattgctttaaaaggtaataacttttgtagttttgctggataaatattatgtttaattttttttaaataaggtatagaaaaagatttttttatagataaactaatttaaatattcaattaactatttattgttaatataagttcttgatattttatcctaaacttaggaattaagttttcttaatgcttattttttccattatcaaactttatttttagacattatttatacaaaaatattatactaattaaaaaattaaatttcagtaaaaaataatttgtatataaattatttatatttttatgttataaaataatattttttaaaaaagtaaaaaatatcaagtgcaacacacttctccctgatttcacagtactctaggggggattatgcatgaaacttatatttttttatttctcttctcaagtaaatgcttaaaatttgatatgtgcatcctattcttgtttttttattttcttcttctctgtttacatgaaaaaatataaaataaaactttagaagcattggtaatcacataacggtatcacataacggttcttttaatgttttttttttttcataaaatacatatggagaaactaaaaggctattttactaattctaattattcaaaaatgttaaaatattaataattatatttttaattcaatagtttctatttttatttataaatatttgtttgatggcacatgtatttaaaagtatccatgctttatataactaaaaaagtatccatgcactgtattggatactcggtgtatacttacaagttacatcttttattgctttaaatgtttagtacacatttggttataacttttgctgaaaaaacattgttttttagttctctaaatatatggcatataaaaaggtttttactatagatagactactctaaatattcaattaattattttattattaatataaattcttaggatttgatggtaaactttggaattaaattttcttcatctttgagtcattatttattatttatgcaaaaataaattatttgacataactttcttttaattcttttttttaatcacaactattctctattagaaataatcatattcgataagattacattgagccacaaaactatccatccaatgctcaatatttgaattcaaaatctctaatatcagatgattcacatgcttaatgattttaaaaatattttttttttatctttctttcaattatttacatgaaaaattacttttatttaaaatactttgcaaaattggtacattcctttaagttacaaatataataaatgttgtgaatgaaaatatcatatttgatcggaagaagagatattactatattttttttacggggtatattactacactaagcaagtctgttttttaaataaagattattctcgctatcttaaatatattaaaaaataattgattctcgataattaaaaattagttacaaacaattgcaccgattttacttttttttttcctttgtaaaatactttttattaaaattaaatatcaagaatcaattaaataaaaatattaagtaatgtgaaattaattatatttgggaccactaaacatgacaattttcccagacgggagaaaataatcatgagaaaaaatggtgaatacaccaataaaattatttagaaaataatacttttggataacagagaataaaatagggaagatgttgcgaatgctaggtgttgggcatggaagagagtagtggggcatggcgaagaaaatgacggtggcatctgaacgaaaacggtagcaatcccgttaagttaatgttaattcttttgacgcataaaaaggaaaggaaaacgtttcttattcaaatacctataccaaatccaacacacctaacaagcttggttcgtattcattctctccttctcctcagaccaatccctttttcaattctcatagcatagatctccattttccaattcaaacccttttctctttcttccctttcttttcagaatacacatgcggtgttgctttagttattgtgttttagattttgaatatggttcttctgtgattgatttttaggttggtaagtcatctacaatctgcatcatggaaggtgttattctgagaagggtcattccttcggataacagttgccttttcaatgctgttgggtaagctaagcaatggaacacaggcccttttttttttggaattactgctacttgtacaaattattccacttgtgatgttctttctccttccttttggttttgtttaattgtttcagatatgttatggatcatgacaaaaagaaagctgctgagttgagacaggtaatttttttttctgtattcagtttatttgtgaatttgcttctagtgccgaggggtgcttcatttctggctggtcaacttttgcctcaagatatgtttttatttttggagtaaaacatgttttggtccctcaaaatatatcgagattcagttttaatcccacaaaatatagagattaatatgtttttagcccctacattttaacaaaaatttcaaagttaaatatataatcttttctactagaaaaatatcatttttcaaacttgaggtatcaaacacaataaactcaagatttggaccagtgaaacatatcgtagtagtgttatcaatgggggtggtagaacatggcggaagggtaaaattcctccatgtaaacacgccacggtgggcttctcttcacgaattgcctatggtggttggcaaaaaatctgccacgccatgacgcctcctttaacaacattgtattgtagaattcattttcaaatcagagacctctctacaggattggaagaaggacttttcacccaactagttagagtcctccaaccgtgtcattctcgaagtgtgatatgacactgtgaatacagaggttggaatgtgttgaagcatactataaaattaatacatttttattccctactttttcttcaaaaacatgtgtttttagttcttgacaagagactaaaaccacttcacttttaataaatataagaactaaaacatgttgaatttttatagggactaagaccaaatttctagatattttgagaaatcaaaaacatatttttattctgaaatgttccttgtagtcatagacatatttttattaaaattcagtaaaaagagcttttggaaactgatagttggcttttcaatcattaaaatggttgcaacaaatgctaaggatgagtgaaatacttagatattaatatattagataagatatatctagtacctaataagatatacatattttctgttgtaattggctctatataaacattcatcctattatcaataaagtaagctgcaatctacaacatttcctacatggtatcagagcctaataattccaggccaatttttttctactgccatgtcttcttcacgtaccttcaaaatcaatgaacgcctgcattccgcagttgttgctcataccacttcaccagctcctctgtggcttcatcatcctccacaccagcgccacttcctgatctcacacccgaccgagatgatccaacgtatcctgactcttgctgaccaatgcaagcccatgtctgaacctttgtccaataagccattgtcctcctcttggcttattgacagcggtgcttcccaacacatgaccggagacctctgttccttacagatcttcgtcgtattgaatatttagttattttttatcttcatactgcatgaagaatttttcagatgcagctatgactaataaatgcgctttgagcatttttattttacaaaaatcgactttgaaatattatatatggctcaacatacctatttttcgctagctcttgttgttttcaattcctgacatgagacttaagtaacttctctggtagatctccatattttgtcatcaattcatcatatgcacttgtattatggtccatcaagccccatgctgtgctactcaatgctttccatgaaattacatgcaactaaaatcttgtcatggcaaaatatttttattttcagatatgaaattatatagtctatcatttaagaattaccagtcaagtggaacttttataccattgtattgcctaatatctttgcattttgagtatgttatttcattatttcttacatattttgacttaatatttgtgtgctatttgtcatttgacatgctaaaggttatagcagcaacagtagcaagtgatccacagaaatattgtgaagcatttcttgggaagccaaacacagagtattgtaactggattcttgactcggagaagtggggaggttagttggcctatgtttttcgtaatcaaggctattttaaataaaaagttagatggaaatagttaccaattttcactcacaaattggaactgctacttttggtgttactgtggtgagtgtatgaatgtaatgtgtggaaaattcatttttatttgaactttgaaggtgatgaaactcactcaaagataggttgatttaacatctgagcttttaataaactttgctaagataaatatattatggagtatatatgagtaaaatatattattttcctgaaacgcagagaggcataaagatttaattaaaatttgggaaattttatttaaacatctggatacccagagaatcttctgcgacaattgtttaaatttcagttttgtttctaaaattaggctttgatataaatttggtgggtatagattttgtagttgatgaatttgacatgggtttcaaagggtatttcaaactcctactagcaaatttaacaataaagcactgttaactttttgttagtttgatgtgctaattaagctctatatttttgtgaaggtgcaattgaactttcaatattagcagattattatggacgtgaaattgcagcatatgatatccagacaactcgatgtgatttgtacggtcaggttagccactcttatgcaatctatatgctctcaagttttgcaacctcttatgactgaacttttctattttcactttttgtgaatacttttgacaggaaaggaattattctgaaagagtgatgctgatttatgatggtctccactatgatgcattagtggtgagtaatttcatataccagattttttttttatcatccattccttctcttctccgaccccaattagtttgggttaaaggtattattattgatgttgatgttgattatcattccttctctttgtgcattttttttttgtggttttggaggtgaattgtgagattacaagtatatggtatttatatttatctactacacatgaaacaataaaaaaattaaaaagttaaggttcatatgtatttttgttttcatgttgcctgatgattactcacaccccttgtatgggtcagatgtctccctttgaggaagctcctgaggagtttgatcagaccatatttgctgtacagaaaaacagaagcattggacctgttgaagggcttgttctaaattttgtgaaggaccagcagaggtagttcgctattcttattgaaccttcttaaaagaaagagataaatattatcatatttagataattgaattgcataaatcttcatatttggattctttatatatcagatttgttgtgaatatcggtacctaaaaggtcttctttttgggcatgtattttaaggtttcactttcagaggagttgggatgcatttgaatttggaggattgtggaaatattttctattttagtaataattacaaaattcacctcaattcatgtttttatgtgcaaatatttaaaaacaaaaaataaagtgaaactaatgacatttttgtaattgttagtgcaaacagaagaagacatttttgcaaatccagtgcaccttttatcaatttagaacaagaacatagtgaatgtgccgcaaagctgttaatgtatatacatagactgataagttgaaaacttcaactttgccaatttctattgtcaaacaatacaggtgaaattatgcacattttttaagtgaaagagatagttgggctatgtatcttgtctgccagtaggaacgtatattttaactctgcaataatacaaagggaagtcagtttgttttatcttgcatgatgtaattttttttaatcttctcaatttaatttcgatatcatctcgaatggcctctcccaattatttctgctacttagtatcattgcatttatgctatgcccatgatgctaatatatcatggctacactttctcaggaaacggagttacacggacacttctaacttcactctgcgctgtggagtatgccaaattggagtaattggtcagaaggtgatccctcagtacctgatgctttgctttattctatttacccaccttagcctattctcctttgttctaatgattctgagtgctttttttttttttgcgaacatttcaggaggcagtggagcatgcacaagcaactggtcatgttaacttccaagagtatagatgatgcactctgttgatttgaatgagataccaagttcatgtgtaatctccgtggatttgaatgaacatcattgatgaaaggtagttgctttgttgcagacaataaaactgaataatttctgcatgagaattgttgtggcaacttgggttgtaatattagttccttggtctcgttccacaatgactgattataagaaactcacctctagtggcagactagataaagaaactaattagtagtcaattttttttttttttatattctcttcctggtaaagatttttacctaatgtatttcacttattttccttttataatttttagtgcaataactacataaactcacgccactattttaaccttggccagtgttgaatgcttttgatactatatataaatcccttttaacgatagtatataacgactctcgaaacaaatttacaaatacttgttctagccgtcaagcttattgttaatcatgaatttcatatgttgatttatgttgggagaaaataggtattgttattaataaaaacagtgaaaaattaagttgtgagttcattgtatttatataagaaaagaatatctaagatattcaatttttcatttatgtcatctatggattttccaacagaactacatatgtaaaaagcatatattattgtattgacttttggatacacttttaaggacatttaagactaaggtagagataagagctcaaaattaacccttggcccaatcctatggttataagaaattttgttgtgattccactgtgtaattgtgttctcaccctagtcttgaacttcctcatatatatcattgattgtttgaagatgtccaacacaaatttctttcttctttatggccctccacaatatctttcttagtatttgatcatatgtcttttctaactcaataaagaacatatgaaaatcttttttattccaacgatttctcctcattaaatgctatagcaattatattgcttgcatagtttacctcctaggcataaatctaaatcgttttagtaatatgagtcttttttcttaatcttccctcaatcacctttttctcataacttcatcttgatcgccaataatttgcataatcttttttatatcaatattcttacaatttggttaagagtatcactgcttcactcttctggtattttcttgggcctcatactcataaccttgttaaacaatttttttttttatagaaatgtgccaactgatacctttctcccaaatcttacaataaaaggctaattttggtcctcgtcccttgtgtttaacctgatagaaatttacgtacttaattaaataacttctaaaagttatttttctgtctttctatagtgtcttgtacttttgttccataacaaaaacaaagattttattgtcttcatccttaatgcacttcttttttatccaaatcttgactttttctctctaattttagcaagcctatagagtgtagcagctctagctccacttttgatacctaaggcttggcataatcgaataaaagcttttagttcttggttcagttcctttttggtacttttcttaactatcacacattttctagttttcagcattctaacacaagaatcatgctttaaaacaattcatttcaatcttaactttatcttatacactagattccatcatcaccaagatgttttatcctcaggtccccaactcttgattcttcaagtgtcttttagctatttttccaaccctttatcccatcttgactttttctcctttttctcttttcctccataatctgatgaaaactttggttttctccttcaatagcacactttgttgatccatcatgattttttttttcttttccacacattcatgactaagactctgttgagtagtcaaactctcctaagtatcactttgtagttcatgcaagtttttttttttttttatatacataatttccttgtaaaaataaacaatttgagatgttcctccctcttcctaaaacagtacttattattgcgaaatcataagctaaaaaaataaaatcaagtagtgaatattataatttttatgaagttcaataatgcatgtacccaatacaaactacaaaagctctgcaacaaggtcattatcacatgtgtcagtgttattactttaaatttttaaccacgtttcaattttgaatttttttaattatatacacaatctgtcgatatttttcttgtaataaaataatgatttaatccattcgcaaattgcagtgaatatatactcctatttttttatgaatactcctatcagtcgtttataatacaagaagataaatgcaacatatatatcaatatcatattcatgggtgagatgatggggaagtcaattttattttgaaaagcaattacaagatggtgatattgatatggtatatcatgtcaagtgaacattactcgtttactatactaatatcattgtagttgttagttttaccacttaccaatagaaagattgtcatcttgtaagcattgagatcgagtgggtgacgtattgtgtgcgtgtgcgtatacagggtgttcttttaaagatgatgaggcaatctatatggcatatgaacgtcatacgaaccaatgaaaaaatatattgcactacaaaaaaatatttaaaaccttatggaatttcttttgatcggtatattatttatcattaataaataaacatccaataagtttcaatacaaaatttattaattgtcaatagttgtaatagaaaattactatagtgaagatataaaagcattattcaaatatagccatataagtacttctgcagaattatttagcgatactcgggagagggaggataaatctttttgatattttattgtaaaataaaattactaaaatcaattcaatcacatttttatcaccaatgccatagtcaccttaaaaaatcatctttatgaacatgtgacataaatttaaacaaagctattataacaagactcattcagtcaatttttgcctgtgaaaatgcataaattggctttaaattttaaaaaaataatgctagtagattacctgtaagtagttttttcttatgtaaaaatgtctgtcctaacttgactgaattggataaacgtatctttgcagtgtagattttttttgttaatttttttcagatatgacatttggagctttttatatcaaataaccaacacaaaattttaaattattttaaatcattcgtcattttttaaaaaaaagagcaaataattcatttaaaaaatactttaaatcatatgtatagtagttttatatactattaattaagcaaaataagagaatattataaaatgaaaaggtaatataatccgagtaaattatttttaaaattaaagagtgtttaattacttttaaatttttgtacataatcttaaaatgatacttattttaaagttgaggaatagtaatttgttgttataatagtcatattttgggtttggacttggaagtactgccggcagactagaatacaaacatttgtggtaggacttaggaaataggagcagtgtgaactcaaaacttgagatgtaattctatccacaaagctctcattaattcatgattgatcaaccaccaaatttcgatagtgacgacaaagagatttagttgccctaggaattttggaaggttttacaccatattttagaaaaatatatagaaagtgtgtaatgctgaataggcatcatacctactactccaagcttagcattaaatgatacaaaccttagttgtaggctagagcatttgcacagtttaatctcatggtgttgggtccatgacttgtacttggtccaactttcagatccaatttccaaatcaatctttttttccatcatgtgggacatgtatgataaattaatagtgcaactcatttcaaaattgccaatgcactgcttctcttcaccccattcaattaatctaccatgttttaattcccatatatgtactactattcacagcactgccatccattgtcataatgttttactaattcaaagatgaaccatatgtgggtaatattaggcaacgtatcttgaaagtgatagcttcccattgtttgttgaaaaaaatatccatttttgtttgaataaaaattactcgcgggccctaattaatccaccgtttaacgttacttcatacaatatgtaaaaaataatgagtcagcttttaggagaaaaaaaatggtaaacatagtccaagtcgattagccatcaatcagaaatataaaaaaaatatttgtaattttttcatccttttcgaagatcttaccaagccttaaaaaaacaactctccttttctcgtcaacttcaatgctgctattatagagactaaaaaactaataacaaattgtgaaagcgaatctcacaaccattcattcacgccactcgccactcaagttgaagaatgaaagtggtggccaccctggacacaatatgtatggtggagcagatagaaaaacatgttacagaatctcatcacatttctcaaccccacacaaaaatttatatccctatatacagtcatgaacagaacataccaatggagttcggtcgagcaaaagaatcattcttcacaataagtaaatcaaaattcgaattcttattagaaaaatatattgttttattgtggattattatctcttgaaagtaacacatatcagaaagacaaacaaacaatttaattgaaattatttttataattcacatatatctttcattaaagacaaagcatgatctaattaagtaaaaccaccaatattcagatagcaaaagtctatttctcaaaaaataataattaagatgaaataattttgtatcaattaataatataaatagaaattgagaaggacgagaaaagtaaaaagaagatagtagatcaagataaatcaacctctaatagtgatatatgtagggtatagcatcaaaagggtactaaagttttgtatttacaaaagaaagaaaaaagtgtaagcacccatccacccaccctggttacaatattaacattcccctagaagcacagaacaaaaacaaaaccctagtttatgatggaaggattgagccaattaataggcccaatacactgctccaatatctaattaattacgttaatgatcttctggaatgctttgaagagcaggcctccatggacgttgaagagagtgattgatcatcaagtgcgccaaaacctgttccattctcaactccttcacctccactttgccaaccaactcctccaactgcttcttcgttatctttatcttcacctctctcctccttttcttaacaccgccgctctccgccgccggaaaatcctcccagtcctcgtcctcgtcctcgtcggtggagtatccaatccgcgattcgcgcctcaagcagttgcccattttgttttgtgtggctttatgaattgcaatgatggaaagtaatagctaagtgggtgatatgatattaccctatgtagcaccgataccgacacggtattttgatacgttatcgatacgtaacttcgatacgtgatacaaaagttttaatatttcgatacggtctcggtacgtcttaatattaaataattttttatataaatatattttatattaataaaatataataaaaaaattataaacacaactaataaaaaatatctagaaaatgatataaataaaatgataatagaaaatggtaatagaaaataaataatggtaatagaaaatgatataaataaaatgaatttagctgtaaaaaactcacgctcctctctcttcctccactaactccacacctcactcacgctcctctctcttcctccagtaactccactctcctctctctccctccaggcttctgttttctgtcccatctccgtgactccttccacggctccactctcttctccggctccctctcttctccggcggccagccgcgctggcgtcggtctccctccactctcctctccctcacggcctcacctcacggctcacggtcacaggtcagtgactcagtggtcacgccgtcagcccgtgcccgtccgtaacggcctctccggctctccctcagcgtcaagctctctgctctcagatcgctggtcgcgccgtcgcggtctccctcacggcctcacctcctcagtcctcacgacccttcgacaattttttaccactggatacgcgaatttgcgtatcggccatgaatccgtatcggacgtgtgtccgatacggtggaaaaaaattatgcacgtatccgtgctacatagatattaccaatatatagagagataggtaatgaaaaaattaaatgagaaaatgggaaaggtcaaacctaagtagtgccacgtaggatttcctaggtggcaagtgtgggcccctttgactctaacggacttcaagttaaaggtatcttacgggatcacattctagccgacgcttagacttcgactggcgcggctctacttgcttttgccatcccaataaaatgtcttataaataatgagaatgagccaataattttttattttttattttttatttatctaaaagaatcgtactcaaataccaggtgatccacagtaactcacggacgtaagttaactttcataggacttttgtaacactatttttattagccaggatgattttaatttaataaatcatttcgagtctaaatttaaatatataattgagttaaatctctagagaaataattttctcatcaatttaaatttaactcgagtgaaattatattttgtataaaatagttgcattctaataaaaaaaaagcaagcccactattattaaattaattacgttatttatttcactttactataattaaggattttttctaagtctctaataaaagatatttgtgatttagacaaaaaatatatttcttctcaaggttctattcaatatattatttattttattattttatacctgaaaagcaagtaccaagtagggcgaatttttttggtgcatatacagtaaaattaccagatattttctgaaaaaaataatgagtcaaaaattgtagaacaatattgaagcataaatactgataagacgaaatttagatacaatttcataaatatttttaattaaaattaaaggtttatttcagtaatttatattaatttttaatgaacatatttattatttaaattgccgaaataaaataatattattaaaaataattacagaattgtatttaagtttataaattgtgtatctttaagcaatctagtggcatgcaagccatgaacagccgcgaagcacaagtcaagcccctcaaagttcaccaattaaattattattattatttttgtcatgcagacagcaatgaaatgttcaattcaatattgtttcaggtgtgaacatgggcatggtaggaatctagcgtaaacttttttaaatgaattatctatattcttttcattatttttaattacttaaaaaggcatttccaaatagacaaaaacgaaactgggcatttccaacaacgataaattgttgccaaagaatttttttctccttgtatagtatgtagaaaaatagttattatataattaaactcaggatacaaatctcattttcatttcccttcaaattgtgacaaatgatcaagaagctcgtgttataactttatatgaaattagatgctactataaatttattggaaaatgcctttttatgttatgagacaaacctagttgtcttttttatacaaataaattatagctatttaagtatgcggttaaactttaattttatattccatgtcagattttgatcaaatgtgttcttaaaaacacacagcttcatcaaaatatatatatggagggatcataaagtgataataaaagctggaattagttggtaggttttaggtgtgaaaagggtataaacctggaatctgaggacaagtttcaaatagaagtagccacgtcaggtgtgaacacaaattagggaacggaatctttgagtgaaggtgctgtttggctaccttcctttcacgtgcaatttctatttggctgacccaaacacacttttttcattatcataaccctaattatatatgtagcttatatatactccctacacgactcttgtggaaaaatgatcaataataaacaacgatcgttaaagaacgcttttcatttaaacaacgacatagtcaattccataattattagttatatagagttattttttatttggattccatacacactgtcaaaatcgatcggttttacctcctctgttcctctcagacctattctcaaggacattcttgatgcgttatatatatcagaagccagaaggactacaacgatgcgttacataacaccgtaattacttcttcctttaaaaaaaaaaaaaagagatagggattattttaaaaaaaattaaaaattataggagttatagttatatttttaaagaattaaattaaaacttattatatttgcaaaaactaagaatatattaaactcaattttttaataggccagtgcgatggttgaaaaaaatatgtatatctatgtattgagtttttaatgtgtttaaagattttgaatgatatagtatttgtttagtttcacttgggatgttttaaaattatgttcaatagcagttaacgtgatttcatgtaaatttttatatttatttaattttacttttgatgaattgattttgagtagataacttttacatgtactaagtttcactactaacttgcatttataattaaaaaaaacttaatatttttaattaaaattaatatgatttgaaattaattttactaatactcatcggccttatcatagcccaatgcccctctcattcaacgatcatattcttacgcatataaaattcatgcaaatacaaaagcacgagatgatgaacacaatttattaataccttactgcaaatcaagggattaaccttaaagacacttaacatgcgttatcatgcaagagacaccatcctaactcaataataattttagaagtaaacctaagaacatgttccagtcccaagtaaacaattatctctataaatttacaccctttatctactattgcaaatactaacttaatcgtcaaaatcattgcaagtgctccatggaaactggactagtacgaagaaaatcatatgagatttccaaaatccaccttaaatagtctttgccttgagctggggaagaacaaatatgaaactaggttgttttgtcacaagattcttttcgttgccatttcaaacgtgctatcctcttattgaatatgaataaaagcgaatgttagcttatagtcaaccttttggcttttagatagttaaagttaaagcaaattgcatagcagattcgaattgtaatagcctatctatttattgatatgtcagcattatatatgttaataagttgatatgtttatcactatatgattatatattttaaaaaaattataaatttctaagaaactttatccaaaatataagtaaatttctaaaaatcaaaaccttgaatcattcttgcacaaacgcgaatgctggatcacgtgctgcacccatgaaatacgtgcagccactcatgactttatgtgtgcatgcaaatgttgggcgccatggctatcttaatctcccaatggcttattttcttttctagggccatttcattgttgttatatattatatggtcaattcaaatatgacttttaacttgtcgaatgttgactactatcttccctttgtttgacttctaagtcttaattaagcagcagttagctgcagactctagctaaaatattaatgtttttacttggctttcatttgacaacattgcagggttaaattttaaatgaatatcatagtattttgcccaagacttgtgtagttgtgtacctgtgttagtaattaactaatcaaaggaaaataattggtttctagtagctacctaattttccttaaatattaattaaaaatcaccgcgtgtaactgatgttgattgctcgttttacaactactgcgtcaaatgtactactctatttcaataacggccttaattaattaggacttgtaaaagcacaataggttatagttgaaattttctactttccacgtttaggtgtatcaaagttgaataatcagtaataaacggcgttatgttttaagcatggcatataagaaaatatgaattataaaagttaaataagtcacatctgagtgagtgtaatacatgttggactgcacaacatgtcaactactgcatatgtagcctccattgacattttttttatcaaacattaataaaaacattactacaaatctttagtaacattaaaaattatcgtcaaatcataaacaaatattattaaaatatttttcacattatatcaaaattgttaaattcttttttaacatttttagactttaacaacatgggttatacctaataacattggataaaatgtcgcaaaaatatattagtaatatttatttataatttaactatattttttaaatattgtcaaaggtttttaatattaagtgatagacaaaatattattgggaaatattacatatatactaacgcccgttgattttttatgtttgttgttgatgagctttacatttttgtttttttaaatgagacaataataaatatatagaaattgccttatagaaattgtaattagttaatattattaatttgtaaatatagttttttaggattaatttgtagtcagatacttttgtttatagatcagtaaatttacactacagtcaatctattacattcatattaatgttgattacctgttttttctttttcttttctaagcagtaatataaattatatagagtaaaaaaactactctagtccatatctaaacttttagtcagaccaaaaatagttaagagactccaaaacttacatcattgcatattaatgttagttactcttgtataaacaggacttgggagtcccaattaattcaacacaagaagattgtttcaagaataactggccgggttaaagaacccaaaaaaaaatctccattctatatattcatattaaactgaatgtactaatcaatgtgtgctgaagaatcatgttcggaaaaaagtagattttcaatacaaaaaaagaacaattttgagtcactttttacattttctcttactctatcttctcctttttgttttatcatttcttttaaattaaaagaaataaaggatgtaaaataatttttattttagtttcaaagttttcattttaaacattaagtttaaagtcaattttaaataaaaagaaaaataaaatttgaattaaaacacatgcatacaaattgcattgggaaattgcttgatataaaaataaaataaaaaaatttactggcaatgcccgttatataggacaaaaattcaatataaaatgaatgttgtaatattcttcaaagatatatacatacaaagacagagttgagtggctatctactatatagtgtaatggctatgttgcagttatcaagtgatcatcgtttgactctatatcattaagtggacccctatctttttcttaaaaatataagaccacaaaatgttttaaaaaattgtttgccgacacctactaattaaagacctcctttttttatcctttaatctttgagagatattacttaatatgtagagtgtagactcaattcctttttttattcggttgagttgaataagttcagtgagtttttttttataattcagttcagaccagaccattgaggttgaggttacacttatttcttaccctaatgggcttaattctgagccgaacttataagcccagagtattttacggtcgcctgttgtggaagacaaaaagcccacgacacgattgagtttacgtactatgggcctttggcacagtccaagaccaatgttacaacccctgtctctttttttttattagatacataacccgtctctatctcttcacaaaaaagttataaataaataagccaatccaattttagttctttttgtttatcaaaatttaaggcgagaggttaaaaaaaaccttaataaaatatacttagaaaaaaacttaaatttatcacatttcaattatataagtaaaaacttgaaaaattacgaaatcctattttactgtatttaaccatttttttcaaaattttcaaaacttaatccttagttcgttgttaaatgctaaacaaacaatagctcgatgtaaagaaaaaaaaaaacgaacaatttccttgaagaaatgtatactttcctttgtgaacttccctcgttaggaaaaccaaaatgtaaaggaccaattccaattataatccaaactaaagaaaagactaaacaagaatcctaatctcatttttccttttgcccgaagaatgcatcataatctttatgtactgcaacgcatttatttcacggattattttttatttttgaaaatataagattgaaaaatattattctcatacttattatgaggtaataaaataattattatcagatatataatatatttttttaaaatacttgtgaataatatttctctgtcatattctcaagaaaaaatattttcagaattaaataaataattagtgaaacaaacgccctgtgaattgatttgtttgttagtttgaataggtaaaaaagttgcaactatacgtaagaaaatgataagaacattaacaaaaccaaggagctaatcacaccacacacaaaaaatctcgtaaaaagctgataacaacgtaataaatatattatattaagttgttttaattacatcattacttttaactccgacttttaatatactcaggtggaaaaaaaaaatctttttaaatccaaggacacatacccaaacggaaattaagttctcatgtaacaagctacaagctacatcaagtaagaagtgtaaaacaattagtttatacggacccctgttgtataatcattatggcttctggtataagataaaagtgcaaacctatagctataaaaatagaaataatgacactaaaaatggtattgtttccataaagtagtgacccaaacttttctttctaaaggtactaaaaagaagttccgtgtttttttttttatgtacatatacgaaaaataaaacagcagcaagaaaaaaaaggaacacaaactagataaaaggggctttttagtttgtgttaattggaagatatcaatcggaatatgcatttctaatgggatttattccctattaagaggtaaagcttttgtttgaataaactttttaataaatatttataaaaatataaatataaattgaatcaatttttataagttaaaattaacttatatattaattaaaaagtatttataaaaaataaatgaaacaacttttataaattaacttgatttattttattttaaaaaataatctttagtacatatatattaaaaaaaaatataacactaaattttatattatcaaggccagttgattcatgccttttttgataaattgtgagatattttaatttaataaaaagtaaataatttgaaatttgcacttttttactttatacatcatctctctaaaatcgtgaaaaaataatacatgaaccatatttcatgacgtgtcacccttagatgcactatttttttgtaatattctaggcgttacattccaggcaaactccaacacgaaaggtgatgggtttaatgtgattttgattgggaaatgacgtccctacccttacactttaaaaggtggtggtaagttggggaggggcttttaagtcttttcgggattgatgccagcgtagagagataaactgataaagcatgattgttcagctccaagggtcgctttttttgcagtgatcaaatcctcatcttctctcaatcctcaaccagcaacctctctctcttctgctatcactctctcactcagtcacttggggtacgtattgttgtgttcttcattctccaattgcacgttttctctcatttctcaattcaatttctcccatttccctcttccttttaacctgtgaggaaaagggaattgtgggttctccttatttcagttcaatttttcttcttagtgttaaaaaaattacctttattattgtgtggagattgattcctgtaatttgttgaagggttgaagatgagaatttgtggagcaggtatgggttgatattggatttcctttaatttatttggtggacttatttccttcatgtttatgcacccaattctgggtcttgtgagtttggttttatttttatgtgattctgttccaattcccaatttatgaatagcaatggatgcacactgggccagctgtttgcatgagaaaatataattttatttattggcacaatctttgacccaatacggatttccatttattggaaattctatgaaattggaatcttatactatactacttgtcttctttttcttcccccaagtgagtgctaatagttaaaccataaatcacttctatatttcataacaaggatttgtttttctctatttctgtctgattgcatacatgcatgaaagaaagagtatcggctaattgttttatttgaataaaaaatagtggcgtgtttaagtgttaaattagtgttcaatagtaggcacagttgtatgtgagtctgcagcttgtaaagttgtagtccatgtttgggggagaaaacacatatactataagaaaaaatatccaaaagttagagggaggaatatatgtgattaggactagaacataaagtgatgtgatgggatgggagtttaagttatttttaaacctaattatctttataaaatttaggacgtgtttggtttcagaaaatatatgtattcaatttttattttcataaataaatataaaaatcttatcttacatttactttgtttactattttccatgttctacaaattattttggttggtcctagcacaaatccttgacaatagggaacaaagtaagcataagatgatatttttgtaattatatgtgagaattcaaaatgaaaacagagaataattattttattagttcagatgatccttgattcatgtaaaacttttatcattaccatttaccaatatacaagtgccatgtggtatagtaataaatgtagcaccatatggatgagtgattcaaaattaatttttaaacttccgattatctgttcaaatttgtaacttcagttgtcttggcatcctgatttggtggctcttttgttttttttcatatatacaagagcattttgaagttgattatttcatttagaaaaggactctcatgttactcaaatgcttagcagcaatcagcagcagctacaccaccacgtccaatttgcttttagtgtttgcttcctcttccctctccagtcctgccaaaaccaagttcctgccctcactttctagattttctgtcaagcgtccgtgcttcctttcccaaactcgtcctcacattgccgtgaacaagccctccatgaacctgttgaacagactcgggtttggcagcgcaagagcaccagagaacatggattcatccattcctcagggtccagatgatgacataccagcaccaggccagcagtttgctgagtttggtgctggctgtttttggggtgttgagttggctttccagagggtgcctggtgtgaccaagacagaggttggttacacccaggggcttgtgcataatccaacctatgaggatgtgtgtacagggaccacaaaccactccgaggttgtaaggattcaatatgatccaaaaagttgtagctatgagactctgcttgacttgttctgggctagacatgatcccaccacactgaatagacaggtatatatgaagttttttattttttttttttttttatttttcacggtatcatgtaaaaaatgaggaagtctggtttctaattgatatttctagattttgctgatatgaataataggtctggactttgtgtattgtcagcataaatgatttttgttacttttggggtttctgtacaattatttaatgatgcattacttctagagttaaacattttgccaacacttttttgattccttgattgatttatttatagtaaattagtaattttggttttctctatgtagccattatttaacagatacatttatggtttgatatctagtcatgtctgttttgtaaattctgttttaatatgatattgtgttgaattttgggtcgcatcaaattgcaggggtctcttggtaatagttgtttaggttgtttttacccttctgtttgcacttggtgggatgtttataggggtgtaacgtaatagatggttaggataaattaagttggattaaaatagatggttcaaaaataaaccattagttcatttatgatgtggtagaattttattaaaaaaaaatccaaaccatccatgactttatatgataaagaaaaatcccaacccatccattaataatgtttcatgggtaagatatccaatccatccatttatttattttttcctcttgtcagcaaaaactctcttattaaaacatctcttcttatgagcactgttttcaaaagaacctgcaatgaaccccagctcctatgattatcattgatccaatatcttaacatccgatggattgtctcctttctttgtacattctgtaactccatttatcagttgcatttaggagttaatgcaatgatgattttgctttaatttcagtgtggcaatgtactagttccaacttcttatgttggacttcaattatacatggctctctagaatgacttgtgagcatccaaaaataagtttccatatggagtaatctatttcagtatttcctttgctacatttttgtcttgtcccttgtttcttttgttctcccctttcaatatgcattcttaataattttgtttcttgaattcactcttccatccaaatccatgcacacacgaacttttgaaaatatggtgactagttatgatatgcagcagcacatacatggattgtacattctaccgcttaagcgcttagttaccatttgatcttgttgtgtggcaggggaatgatgtgggaacacagtacagatctggaatatactactacacgccggaacaagagaaggcggccaaggagtcattggagcaacaggagaagcagttgaacaggaagattgttactgagatccttcctgccaagaagttctacagggcagaggagtaccatcagcagtaccttgagaaaggtggccgatttggtttcaagcaatctgcttctaaaggctgcaatgatccaattcggtgctatggttaattgccataagtgaattgccttcaaagatcaatgcaaccggttcttcagatattgaaagtccatagttttgttagtaagtatttgtaaatatatcaacaaagcttgtgcacactgtatttgaggttgaagatggatatagccatagagttgtatattgtcttttatatataatatggctttgctttgaaatattatctccacgacctttagttagtgttccgttggtgagaaatagaagggggaatggaagataagtattattataattttttatttgtttgatccaaaattttggagaaggtagttgaaattgttcactcaaaattggagagatttgaaggactggacaacttttacattaggtagactaaattatcttttaacttaattttatttgaccattttaaataattttctcctcattcttatgaactatatatcaggtgtatttcttttctgtcataatctctcttctgtcagtttctttcaaaatcttttcttttgaaagaaactgatagcattgtctatttcattacgttcccttatataaatttatttattgattagtaacacgacatttttttgtttttgaagtggggttggggggttaacaactgaacgtatccttttagttagagattaatttcttcaagttatagaaattactaatgtataatttgtttctttcaacgaagtagttttagttttttattgtctcgtttttttttttctttctttgaaacattagaacgtgatcttatgaaaaaggcaaacttcattgtggtgggaggttagggaatttggtggttaaagtaggatagaataaaataactaccatatttaattgtaattaattgtttgatgtattggccggatatggttatgttatctttttgtttaatctatcctgttaatttagcgtaatttttatcttttgaaagaaactgagttagaaaataacatgacatcataatacgtgtatctagtataaaaaataatatataatatataaaaatactatatataaaatatattattaggtataatatatatatatatatacacacataaaccttaacataaagtaaagtatattgtaaaaggtaaaaaaaaatattataatttttaaaaaatacaattttaatataaaaaaatctataattataaatatttacatgatgtgtaagatgtttgttagttaattattattttcatatctgtatatactcttgaaaattttgtttatctctttttaagatctcttttaaattgtctttgcattatttttttatcaaattaattttaattattttacaatttttgtacttaattaacaataaatggtacaaagtaataagaaaaaaatatttttttctcttgcgagaattggaaaatatgactaaagatgttaataattaaataggaattaagtgaaaagaataaaagattatgcattttggtaattttaagagtaattttaaaaaaataatacaaactattaacaaatttaacatgactaattaaattaactaacttatctaattattgtgaattaattaaagaatattatattaggtacaaaagtagtagttaattacttaaattgttttaaaagttggaaacgggtaattgttagtggtataaagaattaaaaggtgggaaacaaaacaaaaggaataaacactacaagaattccggctattacctaaaacccactgtaaatcaaaattaaattaccaacgacttacggtaggctacttatccctctactataatcttgttgatattttgtttatcgacgatcatgaaaaaccctaggtacgtaatatagtggactaaggctaagctcattgtaattcgaggaaaatacaatgtgttcttaatttggtcagtaatttaaccttcgataatagcaaaaaggaaaagaagttagtaattttagtaaaaaatacattcgcagctagctaattgttaatgcttaatggtggtttagagcagactaactttggtgaatcataagtttttctttgctggataaggtgggaaacaaaacattaaccattactaaagattaagattaagagtatgtttggaaatctgaatgttccaccacatcttagacattactaattatatttactagtactgtattatatgcataagttttatcagattattttcaagagtaaaacgtggtgaaaaaaaacgaaaaagctgtgtaaaagataatttgttaattgcaacgtggccttttctggtcggaatttgatcatatacaatattcatattcatttgtgtaattttgactgaatatattaaaatattttattgaagataaataaatattcatattcattttttttgctgaacaaaattataactatcggtaattatcatttcttttagaattatattattcatataaacaacttttaaaataatttctataatattttttttctttctcattcatttttaccatatgctgaaaaaaatagtataactatgtagtattttcttaattatataaatataatctatctttctaacgaaaaaatatttcatcattgcacgtgagtcctgacacgtacatagtctattattttatcaatgctgattatggacatgaagtccccactgaacgtgggctcttgttatttccaattttccatgcatgtagacaatatatgtacatcgtgatcctgcatcaattggtatttttcacattatatattttcatgatactataatataataatcgaaaaaaatgtctatattgttcgataaaattaaagcaacaataacctaaaagtttatatagcaaagcacttgaacgattttatgtttacatcaattaattttattgttcaaaacaactactcaggttacgtaaaaaaaaaaactattaatgttaattaaagataaagagaatactttttttgagagtaagataaagagaatacttaattaataagtttatgagtgtgtgataaacatcaaagaatattacccatgatgaggggaaacaaaaagatcttaacctgtcttatttcattcacatatttatacaaataaatgaaaaataataacggaaataaaaataaatactccatttttataaatatttaaaatatcttcttaagatcacatctttagcgaagaaaaataatcttctatcaaaggggaaaaaattcattaaaggaatattactgttaatttcatatatttattgaaacgaatcaaactaaatcaaacaacaaaataaacatttagaaaataatagcattcatagtaagtaataaatatatgcattttaaaatctattcaacaaacattttctttctgaggaagtccaaccttgctcataatttagaacaaaaatttaaattacacatgctccaaatagaaaagtaaaaaataaaatggtaaagaatcaggtataaattaaatttggacccatgatggtaatgccccacaagagcgacgagccaagtagaacctcacacattctgtgaatgtatcctttttctttcagtttctgcccatgtattggttggcacttcggctttgcatgcattgacaatgtgaaaattggaacacatatctcgttctaccttcgaaaaaatttataagaatttatatccaattggttgtaagtattttcttaatttacttagcattacttgaattaaagagaaaaaaagaaacctaacaatggcaatgaaaatgaaaatcaagttaggatgcgcagccattaaccatttttccagttgtttaatttaagatttttaattttaataagctatccagatctaattctgcattgaagtcgtaccaaacaaagaaaaaaataaagttatcacttattatgccactttatagagggttggctcattaaaataaatagttattaatcaatttcgaagcccatgtgagagcgtatttttttaatatggagcattggagcgcacgttttgtatttatcgacgtgacagtctctttggttgccacgtggagtctccctcggatgcctttttgtgtagggcgaaacagagtagatagtgaagtgtgcaagcaacaaatagatcagacactgacgacacttgctttactatgaagtgccctacacgaccgactcctcgcgcgtgatcagttttcaaataaacattatgcattttattgaagctgagtctcacatatccaagtgtcatgaaaatcggttcgattattgaatcagtcgaggtaagttgaggtagtggataagtgatttagtggtccaaccgatgaatcattaattgaatcgatttaaattggtatatattaaaaatttaaaattatatatgtatttattatatataaatatataactaatattatttgagtaaaaaaagttcattcatactctaaaatctaaaataactattgataataatccaaaatttttaaaaaaatccaaaaaaacacatataaaaaaatcacataaaaaaatcgaacgaacttgatccgaccaattgagtttgaccaaatcaactgtatgatcaatttaatgacagtaccgaaccatttctcgattcaaccgatcggaccagtcgatccgatcagatttcaataacactacacacaacaataaaattgttttgattttgaatttgaaaataactttttacatataaaaaataaaattacttataaaattcctctctttgcataaagaaaaattcaaaaacaatctcttttaacaaaagtaaaactgcttacaaaatttatcttccttatctttgcataaagaagaatcttttgaacatctaaatttttttagttatatgcatttggttcgagggcgatgtctaacgttggagacctaaaccgtgggaaagaattactgtccattagatctatatgctttttagatatgtttgggattatcataggtttacacacattagaacaattttcctccaatctcaaccatcttcaaggaccacgtcgacaagattttcatcgtcaacaacgccaccagtgttgtcgacgacatcgtactccaacaaatcgcttggaacttttgtgaaggaaggtacaaaaaggtgtcgtcatccgcgctctactacacctttggttccagttaattccaacaatgagatctaaatgggagattaatccttctaagtttacgccttttgattgcgtgcactgatcttcgacctggcgtcgatgacgcatgctagttgtcgcggatctggggttggcctatccatgaaagagtctcaaatttcgcttcaaatttgggggttttcatgaatgaaagcgtttgtgttttttgtacgattgtttttttgctttggattagtgtttgaggtttggttcatatttagatttcacttcggatctgcgctcagtggttggagaaggagagcgtaagaaaagaaaggaaatgaaaaactgaaagtaggaaaaaaaatgatgctgtgagaaatcatctccaacgacgactaatagaggtcgacgatgatgctaatgaagaagaagagtcattatgtaaaaaaaaaaaatagtaaaagaaaataaaaattctaatatatgcatgtctatcatatatctcaaaatcacttaaatccaatgaccacggttacttacgcacagtgggaaatctaccttactttcccactgtagacgccgggcatggaaaattgtacccttttcttttctggatgcttgaacaattattatcactgatctcttatctctactttctgaatttgacttgcactaagactttatcaatactatctgaaacgaataaaataaacataatattttttttaattcattactatgtatatctcccctagtttatataagaaataagtaaataaacattgtatactttttatatcaattatgagaaatgtaaatatcttttctaatatattaaatgttaatttttaaagccttttattttataataaagtttgttcacaaatatgagtttaactcatattataaaattattttatattatcaatcaattaaaaattatcattaatataattttaaaaaattataataaaattcaataaacttattatatataataatttataattaaataataatataaaaatactttacaatttcaatgcataacttaattattttcttttacaagatactggtgaatgtgatttgatttaaatataaatttgattagaaattttgatttgtaataatctttttcattttaaaattaacacattcaccagtgaaaaaatatttttaaattatgaataatatcattaaatatagtcacatcttaattaaaccattaattttgtgaatatttttaaataaaatttaaatttatgtcactaataattaatatgaaccaattagattgtttttaatgcagtgtgtatttgtttcttacgtgaaaaacaagaaatagtatttatgttagtttttctataaagtcttctctgttagctttaacaaaacagcatatgttacactttaagtgtttacgtgaaacacgacacatttgtatgaactgttttaaagagtctagttagagttagatgtaaaaagtggtaaaccctttaagtatattatcttctttgttttttgacgaaatcaattttatcttaacatttaacatttgttgtcataaactcagtttgtgaatttgacacctattgtggtattattttaaaattttgacagaattaaaaaatagtctgtgaagtttatatttcatcatttatagtaagtcagatattagtccattatattgtcttcaatggagtatcaaattgacaccttaagtgcctttcaacacacggaataaccttcatatcttagttaatatgatccaagttttgtgctctcatatttgtcgcacttttaccctatccgacttatattatgtggctactatatatacttttaagggttgaaaaagctttggaactcaatagatttctctaactaaagtgacaatgttcacgcctcaccagtttatcatttttcattcgtgaatgaattatcctttgacaaaaattcttaataacttatagaaatagataaaattatggagttgtgtattttttttaacagcagaaaatttattaaaccaagctaagcacaagatgtgccaaagctataaaccaccagagtacaaagacagcttttgccacacatatacattattaatcaatcataaataattttaaatataaatatatattttacaaaaaaattgtacttttagtttcttttattttataggcgacgataccatagtgttatatttcaattttcagacttgcagggaaaaatgaaaaaaatcaacaggattttttctttcaaatttggatttctaatagtttttgtttctaatttcattgattcctgttagatgtttttattttctgatttggccaatggccaaaactgacgatgacataaatgtttgattgcttcattaattatatactcattgtctacgagaataacagtaaatcgaatctctatgatatgaaataaatataaataaatgaacaaatccacctcttttttaagtaatacgaacttgtaattttaaactttttttagaggttgtaattttaaaccttatcatttttttgcaatgtttggattatttcaaagtaaataatatacattccaatttgactaaatgagcaataagtaaaattgggtttagttttttttttaacttttttctttgattcacaacgttgaatcacttttcatcatcattttattcaattaggttaatttaaaatttaaataaatatttctaatgaaaatttaagtatcatttcgtattcaaattttaccaatctaagtctatattttattttataactaatatttcaattagtacctgcattgtataaaataaatatttattttatataacaaaaatttatagtgaataaatacttcaaatttataaaaattattttaaaataaatattcttaatataaaaattatattttaaatttatgataaatatttatagtgataaaatattattttaaattaataataatttcttttacaaaaaatattaaaattcaaattataactaaaaatattaaaaaaaagtcaaattaaccaaataaatggtaaaatcaagtttttattgagtgattaatttagatactgtatttttgtcatccgtatcaatagaaaatgtcaggagaatttacaattactccttgacatttactcatttagatattatatatctgattttctatattatgtaaacaaatattattttctctatattatattaacaatatcttaaatgaaattatctgttaacaaatattaatttagttgataaaaaacaattaaaaaatatcctaattcacacaaaaaaattaataaggaacaattaaaagggtgtgaactctaaaatcttgtaattatgtttgaaagtaataaacaataaaagataaaaatgaataaaattgatttgaaatgtaaattgatccaatttttaaaataattatatttcattatttaaataaaataaatctttcttgaactcatcttaaatatcttttttcacatataaattaattaatattttaaagtcattatccttgaaataaatcctaataaataaaatgtaaaagtaaaagaaaccccccaccatccttcgatcattcaaatcagaacgtctcttccaccagcagcctaacaaacatcgtagcttataaaccaagtagggccaaacgacatcgtataacattttcccgcgcgtggaatcatgataactgatagcagatacgttgaccgtataaacatacggaaagacgtacacctctttgcgtatgtgtatttgtattgtcactgtgttcgtccttttctcagcaaaatctctgaaacagtgaaactctccctctctcttctgtactttcctcgtgtcctctctctcacacacacacttcacgaactccatcactccaacgacacacagattctatctcctctctctctctcacacaccacacacacacactctctgtttccattttatctctttgggccattcattctcgcaagtaactcttgtttgtttgattaaatggctgagactcgccggcgacgatgatgttttccggcaaggggagttttccggcgggcattgcttcgaggagcgtgaacaacccttcgccggactcagatcttgaaccggcgaagccatttctgcgacggaacccgagaactccggggacacggttgaggagacacggtggcaaacggagcagacccgaaacccctcttttgaagtggaagatccattacgatccactcgaagacgaccagaagtcttccgtcgctgggtcccgccggagaacgtgccggagcgccaagaagcaagccgaagtcgccgtgtcggcgaggagactagccgccggactgtggcggttgcatctgccggagacggccacgggtgatggccggaaggggttggaacataaggtaggttggaacataacttgggctactcttcttacactctgggtctggacctaactcagtcgcaaaacctagtttttgctgcgagggttttgctctgcttatatacactgttttgcctatgacactggtcaatgtgggatctcaaacgtttacccttttgtttttttctttctttctgttgtttgagatccctagtttttcttcgttcccgtgtgagtgttgttgcatcttgcatgtgtttgttgtttttgatttaaatgtgattttgcagctacatgctactatgttacttcatctactgtattgtaggccacccctcatggagaaaaaagaattaatagtttattgttggggtttatttattttcatatgatgattttgttgttgcttgattttgaatcgtgggtcttcagattctatccttggttccttgtcattattgttcactttcctgttttggtgttagagttaggggttagccgattaggctttctatgaaattaaaaatagctgtcttttgaagatacaaatgcttttgtttttttagttttctcgcgagtgatgtagttctagtggaggactaattatagtctttgtaatgattggagaaatgagttgagttgggtttgtgtttgtaaataattatcgttatgttgaagatttcttccctaaacgcaaacttgtgttcggagaaaggaagaatcagttgcttccgttcgtgctgcattaaatcatatccatccagagtgcattgaatattgcgtcttgtttggcaaaatgtcaaacaaacatgctgtgtaataatattggcttgtatgaacttatattcttttgtcagttttgtgctttttgagagtaagttgggactttagttgagtcttccttttatatgagattctgttatttgttatctgtacattccagttgaattagagaatgattatcttccatgcactttattattgtcttcgtttgtagatcaatgtagctggtttacaatattaatttcataggtttccatttctcattactgatcactgatgacacttatctgcagaatggaattggtcacgcagggctccagtttctcagtcatcctaatggcatgacccatggttctgatctgaagaagaatccatctcaaagtccccgttccatatttgggacaaagaatggacacttctgtgaggtatgatttttcttactacttcaatatcaatataatataaccattaggagttttacagctctttggtattgtaattgaagattattgactgaatgtcatatacacataataactcaagttaaaactgcaacctgtactgcacaatgatcccaatatcccattgctcggtcatgcaattacctgttttaatcatctttgtgaaaatgacatcaatcatctaattattaagttatagatagtgacaaactataatcatagcaacgtgttgtttatgatttcatattgtggaaatttttagtaatatttcaaaggcctgcccatgcaaacacatgcatattatgggttgataccacccaatttgcactttgaaacaaattatgctcattgttgtattgacccatgctatgtataacagtatagagatggcttagataaaacatttttcatgtaaacctacatggtgaaattagcttttccaatgtctatatgagcaaaagagttttaaaaagtgttctgcttctacactaaaagtgaaagagcagacaattaaagtgctaattttaaacctactttatgctattcagcctgaacgtttccagcttcccaacaatgaaatggagggtgcaacaaaatggaatcctttatgttcaaaaacatcagaggaagcgcagcatatctacagccacatgaaacatcttgaccaaaaggcaagtgctgtatctgttgtatctgctctcggagctgaactagagcaggcacaaacacgaattcaggaacttgagactgaacaccactcctccaaaaagaagcttgagcattttctgaagaaagtcagtgaggaaagggcccaatggagaagcaaagagcatgagaaaatccgcgcatacattgatgacattaaagcagagttgaatcgagaaaggaaaaatcgccagaggattgaaattgtcaattcgaggttggttaatgagttggcagatgtcaaactctctgcaaagcgctacatgcaggattatgagaaggaaaggaaggccagagaattgatcgaggaagtgtgtgatgagcttgccaaggaaattggagaagacaaggctgaagttgaagcattgaagagggaatctatgaaactaagggaagaagtggaagaggagagcaagatgttacagatggcagaagtatggcgtgaagaacgagttcaaatgaagttgatagatgctaaagttgctcttgaagagaagtatgcacagatgaatagactcgttgcagatttggaaagctatatcaggtcaaaaagcacagagccgaacacaatggacatgaaagaggcacagtcacttcaacaggctgccgctgcaatgaacattctagacattaagggattttcatatgaaccccctaactctgatgacatttttgccatttttgaagatgcaaattttggtgaagtaaatgagagggagattgaaccatgtgtttctcacagtcctgctagtcatgcctcgaatattgacatggtgagtcctgaagccaatgcaataagtaaaggtggcattcagaggcgttctgatgtatttttggatgataatggggatatagaaggagatgaaagtggatgggagactgtgagccatgtcgaggatcaaggctcaagttattcaccagaagggagtagccgatctttgaacaggaatcaccgagagagtaacgtctcagggagaagtgtacttgaatgggaagaaactgcaggtgaggagacaccaataactgaaataagtgaagtgtgctctataccaactaagcaagcaaaaaaggtatcatccataacgaagctttggaggtcaacatactcaaacaatggggacaattacaagataatctctttggagggaatgaatgggagactttcaaatggaatgttatctaatggtgtcatcatgtctcccgatcatggatcaggtaaaggtgggctgagtccccaagaccttctataccagttgagtcccgagtcaggaagtccacatgcacatcaaggcatgaagggatgcattcctcgcactgcacagaagaatagtttgaaagccagacttatggaggccagaatggaaagccagaaggttcagttgcgccatgttcttaaacagaagatttagttttgggcataggcattgcacagattgccaacctgtaaaattgataaatgattgatgaaaagcagttcattttagattgtgagggtacaaatatgctgctttatggaaaaatctgctcacagtgatgaggggtcatgaatagatgcacattttctgcctcattctagtttttatttcagttcttcattatcattcatattaagctttaaaagcagataatcttctcattcccttgtgctaaattcctcaaaacctgggatatcttgggaaatagctcgctttgtcatctgtgattacaggccctgcttcattgggtagggtcttgagaaaattatgagaagcatgtagcatgtgttgtactttatcatgttcagaggacaaatgtgatgggaaaaaagatcgtcatataatatagatgatagcattatctactcaagattttgattttctatcattgtgtatgtcgcttaggatttgttgtagattgtattttaggaggtggcaaggatgatttgtggtaccgggacaaaaaaatataacttaatacttactctgggaccttttcctctttctgtttgtctcctttattgttcattttgatagttaatgttgtcaaagtataaaaaaaaaaaaaaaacaatgaaattgaaattagcatttttcctttgtttgctgattataattaagtcgaggtgataattaacgtaaggaatgttttaattttatgatgttacacgagaaggaaagctttctacctttagaagttttaattatgatgtgttcaattttagaggaaaataataaaaataatttttggatataaagttttttgtgaatgttaatttgtgaataaatcagaatgattctttttcactttaataggtgcgaatgaattttttatataataattaattataaagttattaaattttatcatggtaattaaatacatgtattctcatgtttatcttccatagaagacaatgctacttgaatcttatgcaggataatttgaatttgaacgttcatttttttttacaattaaatttgtttaatcattggttttttaaaagaatatattttagaggaaaaaaaagaagatttaattgcattcttaaagaatgtattgaattatgattttaaaagattatgtaaaaatgttataacttaagatatttaattagtttttttggtatcataattgtgtagtttggtcgtttaaattttaattgtgttaatttaatcacttaaattttcttcaaattataatcatatccttccattttgattttattaaatgtttattgaaattaattgctataacaaattaatatttaaatacattataccatctgaaaaacataaaaatgtggtgacctacaaagatagtttgactgttattgacttaattttttattatgtttgtggttatttttataattataataacaataaaaataatgccttttatcctgaataaattaataagctaaatattaaataaaatctgaagaaaaaaattccttttatcacgttcacaacatttttccagcaaaagcaataaaatcagaataaaaaagaactttattgtaaatgaaaaagaaacttacagaataaaaaaatgaaacttacagttgattcaacaaagtcagtgagttatgtaaatcttgattctgtcatataaaaaaagaagacagaaaaaaagagttgaagacggttcagtcgcgcacccgcgaatcagaaatttcaattccctccatttcccccccaaattcaaatccccaaaccctcccttatatacattacatacacacatctcaattcaatttccatggcgaatttcgaagtgccctcattttccctaggtctcgacgatacgcccccccattccccaatccatccacctctttctcccgatcttcatgtctctgactccgactccgatcccgaatcccgacccgacccgccgcgccccctcctcaaacgcctccgtcgcgggcccccgccgccgtatctcgaccccgatgccgatgcctacgccgacgacgacatcgaggagttctcctctcaagaagatcccgatcaaggtcaggttagctaacacttcaaatatttcacctctctctcggctttttaattttaaataataatattaataatttccttattatttatctgttgtaatattattagggcatgcggttccatcggcatggaatcggaatcattctgtgtgtagcagctcgaaagtttcgttgaatggaagtggggttttgacccctcattcgtgtagcaactctttcagggataggaaaagaaaggtactttccaatgatgttccggcttctgccaggttagagacagggaagagtggcttgatgtttcccaagttaaccactagtcctctccgaaggtttcaattgattgattcggacaccgatgatgctgatgttggtgttggtgctggtgatgccaataaagttaaccctaacagtcatttggaacaagagaagaaaacatctgctgacgagaacaaaaatgaggatctgtggaagaatttttcgccggtgaagaatgtttctgttaataggtttcaattgctttcagattctgatgactcggatgttgatgtcggtggtgccaataaagttaacactaacagtcgtttgcaacaagataataaaccttcggttgatgtgaatggaaatgaggatctgtggaaggaatttttgccggtgaagaatgtttctgtttgtaaatttcagttgctttcagattctgatgattcagatgttgatgttgatattgctggtgccaataaagctaaccctaaccgccatttagaacaaaataagaaaacatcgcctgctgatgatctatggaaggattttttgccggtgaagaatgtttctgtcccgacgcctgccttcaatgagatatgtgaagagtactttcgttctgccaattgcaaggaagtgggtggtgattcgtctaaaagttttaatgagaggaatcctggggttagttctagctgccagagggatcaacaacgatgtgaatcaacagaccctgttcatcccgctcatacttattttttccatgaggatccgagaattcggcagttagtccgcagtcgcctgcggaattttaatccactaggtaccatcaacacagtgaatcagcaacctaatttctcacacattgattacatgtaagtcgtaacccatgttcatttgttgttttaatcttatggtaatgatttaaaaagaaagtgattgtcattttgtattacatattgttttggtgtattttgatttcaggggacaatttggtaatggaggagcttcaaacatgcagggagttcaaaatggttttattaatagctcaacaagggggaaaaacaaatcaagtaatttgaatgttgagggatcttttgatgcttctggaggctgggtggatcccaaaattgtttctccattcagccatggagaatcttctagaaagaaagcaacaaagaggaatggcactaaaaatagtgtctcaaaaagtaatagtaaagcaaacaaatcaaaccctgcgaaccaatcatgtgcttctgggggctgggtggaacccaggagctgcaccagtttgccaaaggatgcaggcaaaaggcgtgttcaagcaagtggtgaatctgctggtcattggtttacatcaccagaaggaagaaaagtatgagaaaaagtctttatttttttttaatgttattaagtaattaactggttaaatttatttacttttctcatgttagatgctggtcataagaagttatgcgagctgttttgctgttgtttaaaactgaaatgcaaaaaacccatacagtatgttacttaagatttaaataagtgcaatgaaattcaaattatcacattacataatgcctcttttttttggaaatattgttctatgatttgatgcacacgatcccatcattccaatataactatgtaacactagatagtgatactcaatctcccattgtttttgtaaacattcttttgacattaagattaattgttatatagggaccaattcctacttgatgtttaatggcagggaccaattcctagtggttttgaaattataggaccagaaccataattgagaaaagcttttaagtctattttgtcatattgtataaatctatcagaacctgattctttatccccccttgcaggtttatgtcaacaaaagtggggaggagttgacaggccgcaatgcttatagacaatatcggaaggtacatatacttgcataccattctgatgttttgttgtccttttggttgtgatgtagcactgaatgcctttgatgtttacaggagagtggagcaggattcaagaaatcaagaaagaaaaaaggtaccaagacgacaaatgccaagaagagaaactgaacacttgatggcaagaaatttattatccgcctggtccacatcccataatttacttgtggatcttatgactagcaataccctataggttcaatgctgttaaattgccctaaacttccggtatcatgtgttggatgcggacaaggaagccagccatccagcatgcagcatcgcacgaggaaactgaattggggtcttgttgcttagtgaagatttgattctaaaaaatcctggcaagtagatattgtgagcttatgcaagtagttctgtacagtgcacaaggacctaatgtctttggccatcatgaaattgtaactttagataatgtttcactttttttattaggattcccaataatgcttcgattccatcttgattcaccacttggttctgtgttattatgatagcttgttgctatgtcaattatgcataatttacttctggtgtttgtagattaaagtaatggaacgatagaaatgatagcaaattttaagtaaatgaagacatcaagaagaccttttattccgtctatcttgagcggaggatagagatgcttcgcctgaattgtttgggctatttttgttgcttatgctgtttattggcttcatttgttgatgtttaatgcacatgtaccaaataaatactgaagtttacagacgatgtaaacttaaattaggacataatatttgtgagcggaaacttaaattaggacatacgtgagattagcatacgtgtacagattcaaaaattaggaattttcactagaaaaatagaaaaggaatttaattttccaaaatccttgtaaccttttaattttttaataaaaaggataacaaaattgcttttgttaatagcgaataaagataaagccataaaggtggtcagtttcgcagaagcgtccaatcttcacgattttatttcatccaaaatgatagattgaatacaatttggaattaaattgaaaacttgttgacgagcataaaatctagcaacccttgacaaaaaataaactacttgattggttgtctacgtactaacttattggatggctttagtagaacgtggggccaaaaatgaaatatatatatatatatatatatatatataaagcagattgaaccggtaattaccaatgatttcactgtatttgaagttatctctttcaactccccggacggggaaaagtgttaaaaaaaagttcacgtttatcagaagctattaaaaatttaggccttcagttcattcatcgtcttcattgatgattagaagtattctgcttgtcttcacccttttcttttggaagtggagaacccttggatttcaatatctgttggcatactctgaaaatccatcaaaatagaacattcattagtttttgagataaaatcaatgtatataatgacaatcgagttaaattggagcaaatgaacaatgctttgcttcagaaaggggtataattctgacccaaatgaatgatcatagtaccctacaattatgcatctctgaaaaggaaaacagaaagttaaaatcatacgagtttaaatcttctgtcttgctcttgatatcacttgacaataatactggatcaaagttcttagggtaaagatcttgctgttgcctcgtctctcttaaccactgctctgctttattgcactcattgatgatctgaaaaagaaagttgtcacttaaaaactgatactaagggaaacatcccacaattatacttattcactagtttattgtcgtacctgttctttatcttggggtggaagagaatctacagacattcgatactctacaatgcaacttaacaaatctcttgtagcttgtggtcttgcttctgtgtctttataccgaaactcaattggatctaccagctgcagaagatggagattataagcaagaagtatggcggatgaaacatggagattggagaaacaaaagtaacctgttttagatcttctagttttgcagaataaacatctacagtttcgtcatcaccatcatcataaagccaatcctcagtcgctttcaggctcctagatatgtccttcctctcatgttcgcttgaaaagcttagatatgtgctgaatagctattcatacatgcaaataaatttaaataccagtacagaatgaaaagtagagcatacacatgaatacagctttaataaaatcaacggtaagaaaaggcataaggattcagattttaattctatatcggtatatcctatgcagatgttattacaaagtataacagcagaccatccccagcttcacaaagttttacccttacatttacttgagtcatgacagaagtcattaaactatatacaacagctttttctcattttgatatattcaatactttcatatttacatggcaaaatttaaggctctagtttttgaagaaggaacacctcacagtaaagatatgaaaaagaagaaaaaaaggatcatacaatgaacaattatctattttagcagaagaaatgtgtgaccgcttatacaatgtaattgaatcagagaagccagtcatgtctacatctcattaagatattgaatatgtaccttactcctcgtttcataaatataagactccaacgaattcttcttgtctttggtcagctcaattattctgtcctgatcggcgaactggagttctttttcttgagcttccaatatctcagccttggtcattctaccataaattttttcactcacaggtacatgaagccttctgttggctttacctttttttgtaccatcagcctgtaacaaggcatgatagtaacacttttattttcccaaaacaccaacatgaatcatatctgcaatcaaaacaatctccacaagataaaaatgtacatatacaacatcacagacattataaaaaacggttgcgacagactgacagtgaaagacatggtacagattcagtatcagaaataatcagataattaaaatttagccatataattgttcgtgttaaaaggacaatttgctagaaatctctaatatctgagatatcttccagtaaaaaaaggtgagcaggggagtgagagagaacaacatgggagtacttactgaatgatgtggagcttcacactttttattgatacaatcttctgggacattttcaactgtctcagaaacaggttcaacattcattgcttcagaatttgaatgataatcacctgttgtaactgaatcattcacatgatcctcgatcaactgaaagacaaaaatgtccatgtgcatagaaagatctctcagaaaactaataatgcgatatgaagagataaaattgaggtttcttactgtagctgattcaatactgataatgccatgcaaatttagttgaactcgaactttaattctcgccttacttccatgggatccaaggaaaggatcaatctgaatagaaatgacaaacaaatgcataagcatacaaaaacaaggtgtaggcataagcatacataacactttttaatcactggcacaaggaatggcagtatctcacaaccaattattataacttcattgtcctgtaatattgagatgtcttataatatagaatagacattagcaaatgttagccaattgtcattgaagatactaaatattaaatacagtcatttctctccatttgagaaacttagacagtagatatatggatggtgttagatccaccatatctgcttctcctaacattatgatttgttcaagcatgtgcacacctacagattctcatattgctatacctaacacttttacagcaatgacttcctttgagatcagaacaagcgatggtcagcaaggccatttaataatgaagtctttcgctccttcaagaaagggggaggtgtctattgcattgtcccaagattcaacaacaatagccttttacaaggtggggttggctacatggatcaaaaacaccataatgtcttatcataaataatgtctaaacaaaccatttaaatcttaatctttcttaatgatttaacttatagtttttcttcgtctcttactacctctaattattgaactatcttccatctaattcactctctttatttagagcttctacaagtcttcacatgtgtctaaaccacttaaggcacgattctaccatattttctacaacaaatggtgcctaactttctaaggaatcattcctaattctaccttgtgtgtctacttatccatcataacattcttgagttggcaatattgagctttattccttgttgagtttttaccactcaacattgaacttcaaacaacattgcaggtcttggatttgactcctctaaagtgagggaatgcattctaaagaataaagtgcatttataaccattgaataaaaaatccacggttgaaactatgataaaatacaagcacatgtataacaagtaatagctttatacataattgagtcctagacttacaattcaagagtaaaagctgcaattatgatgatgattactatatagtatatactatttttttttgtagaattaaacataccaaaacagtaaaatgaagaagatgaataagctcatagagactataccacatgcctttcatgaagcaccccaaagaagcaagaatagagagggtaataattaataaaaaattaataacaaagaatcacggacaagatgatctaaactccttcacatcatagtaaagttctaaagcaggcatactgtgaagcaactgattttcggagatgtcccaggtggtaattcatctggattagcatagaatgcttccagacggagcaaattactgcactgaaatgttagaattttaacacttggaatgggttggccttttgggaagagtacaccatccaatccttcacaaattggacttccatcacatgaaagtccaatggaaaaaggaatagaatcctggatctgaacaaacacaggaaattacattaattttatagagagtaatacatgctaatgcaaaattctataaaaaaaaaacacatgattaatgatatctatgaagttagatatatttcaattaagatagacaaattaaatgcagaaaataaacctagcacctatgtaacaactttgttcatttagtaattattacatttctaacctaagaatctacaaacacaaaaatctactctcctatatatacatatcatatagataggataagaatcaatgtgtttttttcaatattcaaacctcatattctttgacatggaaaataggactgagcattgcacactggagagcacaaccacgtgctacacactcacttgcattcagcgtgcggctcagttctctcttaaatagagaagttaataaattagttatagctggaatccgtgaacctgaaccaactaactcaacagaattaatcttttctactgtcatgccggcatcagccaatgctttgtagcagggaatattaaatttctccaataatcctgatgccaaattctcaaattcttccctcttgataaagcccttaacatctttttcatccatcaaacactcaatgctcagatcagccactgcatttgcactcaaaaccttcttcaacttctcacatgctacacgcagcctcctacatgccctggcattagaatacacgtcaatgctgtactgttccttaaatcttgctgcaaaatgactaaacagaacctcatcaaagtctctccctcctaagctactgtcaaaagcatgtgaaagtatcttcatttgaccagcctgaaatgctgcaatagagacctgagtatcacaatgacctatgtcaacaaatgcaacataaataggagctgcattgggaaaatctgttttgcaaactccataactaagaccagttgcagtgcaatcatggatcaacctcaaaggctttaacccaataattgctgctgcgtcgagatatgtttgtctctgtaagttggtaaagtatgatggaaccccaataacgcagtcagaaactgcggtcccaaaatccttttcagctatagccttcaagtgagtaaagagcattgctactatttgaaccggggaaaacgtgcgagtctccttcaagtatttcaagcgaatcagaatgccaccatccgggccttccgaagtttcaacggggagcaattttaaatcattctgaacatcagggtccgcaaatctcctgcctattagtctcttcacttgagatattgtggacttagggtgcatcatagcagaaacagcaccagctgaccctataaaccgttgcttctctccaaagcacaccacaccaggggtttcacgtttggattcatcattcaacaaaacatcaatcacacgttgcttcactgcagcaatcacacagttctcatttccaatatcaatccccactccactcattttaatttactgtgtccttcccccaaactacaaacaactaattcaatccaattcaccctttctacgtcaccaacaacaacccaaaagtcaaaaacttcacacaaagctggcccacaaacataagcttcacatttcacagggcgctattactacaaaaaagaaaaagttggaaacatacacatcaaaatgaaaactttatttctgcatcatggaaagcaatagaaaacaatgatataatgtaacaataaatgctttgaatgaagtaaaaaagttctgaaactgaggaaatgctttgaaatgaaaaaagaaactccgagagagagtaaaatgagataagccaaaaggaatattgagagaaaatggaagaaacctgattttggtgaagagggcttcgagagaaagatgaatggtgaaatgtagaagcagttggaggctgcataattaagttgtaatggcagagagacaaaatcgccacaccgcactcgctcaagccatgataataccatccctatccctcgtacaaaacatttgtaatggaaaacacaagctatcgtcaacgaacaaatttgacaataatcagtttaactggggtaaatatataaaattaattatatttattgttgttatttttaaacacggtttcaatattaataatgatatttctcttatctttcttctcatgttcccatcacattttttcacttattatttatgacatttttcatcttttactgttgtcatcacattttttttttcaatggtcaaatttttttttttagtaatttgagtttatttatgttgtgtgtgttatgtaaaaattggtgataaaaataaacattggaatcccaattaagaaaatacctcaagtctctaaaagagatctgataaatttaaattattcctataaagatttacatgagattatgaaaaatttcctccacgtttgtctccaacattaatttccgattctagtcttagaaaatttgttgacactttttttaatcttacacctatctcttgtacactatcatgatttattcatgtttttattttttgtcatacattcatatcaatattttcatatctattacttcccacctttatttttgttcttttaaatttctaacattaattatcataaaatacaattaaatgtataacacgataaaactttgttgcaaacattttttcaattacaaacaactttcaattgtatcttgtgattgatatcttaatttctctttatgttgtaatattgataaaaaatacttttttttaaaaaaacttgtaataaaattatcacagggagactatttttataatactttaatcatttaaatattcaacttttaacaaataaatatttaataaataattatttttataaaattatctattagttccacattaaaattgatttttatttcaaatgatagaaattaaacatgcatgtgtctttataatttgtgggttgcatgaaagcatcaagactttgtctggcatgaacagccttattatcacaattaagatactcaatattatcacagttaagatactcaatgcaaatgatttgacattcacttcttaatttttttcaattatgataataaattataactgaatcaatttgttttttagaactcaaacttttgaaaatcaatccatccaaaaaaaattacaacaaaatttattgcttttcaaaactcaacgaccactcactaaagaccgttggattgttgggttgacacaactattacttcatttctatgtgtattttttgtgttgatcataaaattatatgaaataattttcatggaagtaatgattaatgttaatatgttattgtgagtgcatataaggtgattatttctatttataattgtttatttcatatacaaaatcatgattcgaacttgtatcacttgattgagggatacaatttattataacttgtataaataaatagttgttggcatgttcttcttccttttatatatgtaatgagggtcgataatcttattcctttgatacaaggttatttaatacaatcattttaaataaaacttttaattgtttataaactttttaaaaaaatatttttttaatataattgtataattattttcaataaagatgtatacttataatagagggtaatttcattgttatcttttttaaaaacaaataaaagtttaattttcacactatctagcatttatcatatcattagtgtgaaaataagctatttgcttaaataaacatagttggtttaaaaaattgagagtttgttacttgtttaatcctaattaagttggacgaacacatttaagaggacagagactgtttttttattcttaacactcaagttcatgacttcaatcatgagtacttataatgaagtttcaatattagaattaaataattgaaattcagtactagtataatgaagtttcaatattataatgaagtttcaatattagagtttcctgagatttaactgaaagctccacatcctcaagcagttcgccaaggaaggggattgtttcagctatgaacactagatattcttctttctagttctccacaacatatttaacaattctgaggcccaatattttagctagcaatttttcactccgtgtctgcatcaaaacctgcaaaaaaccggataaagaaggcagaaatatattcagttgctaaggaatactagtatttgcggggaacaaacatatagcattcaagagctatacatattactgaatacccaaaactataacaacaaactaatgggctaaacacttcaacacataagtgaggcatggatgactacaaaggaccaaagctaacgtattatgaaatggggatgcaagagtacagaagcaagtttagatctttaaagatcattggccggtagggtaggtcaaaaccgcagggatacaaagcgtcaattgacattattactaaagtttgatcaaaatgacataaaagctacagtctatttacaattaaaccttataaagccagataaacatagcagaaaaggtcaactctaacatgactgaaaccctgttcagataaactattcaataagcacttacagaataaggaaaaaaaaaaagagcttaaaatgaattaagcttctctcataagttaaaatcaacttttatagaagttctgatttaggttctctaaaaacttgttttaacttgtgcacacgttaattttaacttaagaaactcaatccattttacctacttattttattctcttagaagttcttgttgagttttcccaaataggacatgattttactatgcttaggtgatgttgataagtagttgttagcaatgccaaaaatggaggtctagcaaaggaagttttggtaaggatttgctcgtttttctagtttgaatgactaatgttggaaagtccacatttgaacctgctggcattgctaggagcccatttgccccgtccaccttgttggcttgctgctgcatcacagctactgactgaatgtttacatgtaagaggagtggattcgttaaattaaaagttttggggggccatatctgtaatttacacttttattatggcctttagagagttaattacttctattgttagacatattcttaatctattgttaaaatgtcttggggcatccatgcacccaaactaatagggagaatagtagaaccagtcatattcataacagtgtttcccgaggacaacgatcatatgcatttcccctcaatgaaaaacaagatagtgaagccagtaagttaccagtatgtcagtatcaatttacttgcccaatcattaacgagtagtagaaaagaatagaaatcataaaattcacctcatgattcaaaggtttccacaaaaggtcagatccaccagtcactgccatttgaccgatgcacacaaccagtaggtcatcaacttccttcacacttagtatattcatgctgtcatccaacagagctggtggatctacaacaagttgtgaaacaagaggtctcaacaacatctgcagcaagcatgatataacagtcagtgagggaatatagcaagcaactatattactgaaggaagctgaaagatttaggaatattttattcctcaatggaatgagaaaacatgcaaagtatttttaaatggaatggaaaaattgccaattgatgcataacctttaaaaattccaataggatttctgtattcaaagggcttctgcatacactagccaaactgataatcacatgtcagaactgacagtgagacaaacttttgattttgctaacagatgccaaggttcaagtgatgtaggtatgtatataatatattagtttcgttatgcgccatttttagctatttttattttccatttcagaattcagttacttaatttcctggtctaatgtcatgaacagaaattgtgaaaaatcttgaacgcttggataaggagaaaaacatactgccaagtccagaaattgatgcattcatgaaggttgtctcatcttataaataatatctgaaaaatcatgcatatatgcaagttcagggaagtcctctaatttgtgttttttttaaactgattttactcaacaggcaacacttgttggtggcaaaaaccacaatgtcgagacagattatgttttgaaagtgcttggtcttgatgtatgttcagatatggttgtaggcaatgatatgctaaggggggtctctggtggccaaaaaaggagagttacaacaggtgatctctctcccctttctaggaatttgttacaattttctttgaaatttggctcttgtagtgatatgtgctcaagttaatctaactggattacctctttagtgtatcatacaaagaaagagggtccaaattcagtctctctatttttttccttctgtttttttaagatgaagttaatgtgaaatatagctttgataggatttaaggagatttcatttagaattttgtttttgactcctaagattggagagttacgacaggtgatctctctcccctttctaggaatttgttacaattttctttgaaatttggctcttgtagtgatatgtgcttatgttaatctaactgaattacctctttagtgtatcatacaaagaaagagggtccaaattcagtccctctatttttttttcttctgtttttaagatgaagttaattatttccacttgtaatatgaaatatagctttgaacaaaggcactaattgaagttaaaaattgtagcaagcaatgacatacttttgcatttcatatcgtaaatatcaattatgaatggaatttaataaatcaccaattttgttcccaaactactatcctctccttaattgtccctaaagtaataaaattgttcaagcaatccttgaagtataggatattcatcagtttaattagttcttaagttgatgcatttcaataaagtttaaggcttaagttgaaaagtctttcaatatttaagagattacttagtttttcttattttatcaaccattaaggagagagtagtatttcaaggatcaaattgatagtttactcaataagtaatgtaaaataacagaagaatattatagtttgacaacaccgctgatattattcaagatggtcaaggaatgtctttaaggtcgacctattggtgagcttttaaaaattaactaatgaagaagttatttttgtttataaaaaaatcgtctcatttttttcttttagaaatacttctagagaagttgatccaaacatgtcaaaaacatataaagagcaatggcgggagatccagggctatattaattatctataagaaaacgtaatgaattattgagctagagtacggacaatattattgaactaatgttattacacataacccataatcaatatttttactaaaaattaatttgattaattagtaagttagtatgagagtgagtaatatgtatgaacttcaaagacatctcgcatgtaattaatcaaagttggcagagatcttgaacctatatgaacatcagctccaattgtcaagtttcagtatctcacttcgatacttggtacatccaatccaacccttttgcagtcaaccacacaaataatttaaatgcaaaatcatatataaaccctaatgcatgtaatcgatatgagaattgttattttttttgtaaaaatatttaactctcttagcattccttgatggcagagaggagcttgtaattgtcttgttcattggttgccaaagcatccttgacgaggcgttcaagcggcttagcttcctcacatcaatctgctccaaaaccttggccttcttcttccctgagtcacctctgttgctcatatccaaagacggcgccatgttggcacgcttctgcgtcggcaacctcagcaatgcagccatttgaagctcctcctcatcttcttccatccattcggcattggaagcccttgcaaacgactccctttcggacgccattctttcttctctttctccattgtgggttcattaggtatttaatatgtttgttttccattccgtattttgttcattcggccctattgtatgatggtttgttttggtccctttctagaaggcaattttctttttaagtatactcatttagcataaatcaaacaaagggaaatcttccaatgcagattcaatgcacttcattaattttaattgttataaattattttaaaattcaaagaatcagacctagaagtattcaatataaatataaatactatacatgcttgtatattggagtgtggaagtagatactgggtaacttttattttattttatttttttttgatttgggggaacttttatattatatttgaactcagagaaatactttttatatatataccaatataaagaccaagaactaaaaatttaaaagatgtataattatgatagggtaatttcattgttatcttttttaaaattttaactaacatattttttttttaacaaacatgttagtatagttgtttgtagtcatttattgtaattttgtaacaaaaagcttttaaattatcatataaaaaaataaaatttaattttcacactatctagcatttattatatcattagtgtgaaaataaactatttgcttaaataaacatagttggtttaaaaaattgagagtttgttacttgtcatataaatatgcaaagttgattatattatagtagttattattttgttgttaatttaaaaacaaactcaatattaataatgatactaagtagatattttgcttatattataaacaatatatcaaaataaagttaattgaagaaatatatactatattttaaattatataaaattctatttacttaaatttttagttacaatactttttagaccttaatagaacagttcaaaacacctaattctaatgtttttttttattcttagcactcaagttcatgacttcaatcatgagtacttataatgaagtttcaatattagaattaaataattgaaattcagtactagtaaaaaagttattgaacaaagtaagtaaaaataaaaattgattggagtaaaataattagtgaagggtttgaataatgttcaaatcttgtactgttatggctaatttaaattggttaattaataatagcaaagaataatactatggacattttaaaaaaagaataacatacgtaaagtatgctagctaaacttatattgcaagtattttatttatttttttatttacgaaaattaaaaaatatgtataaaagatttataataacttatgtatcattttcaatcaaaactacgttcttatatatgtatcactcatgcaacttatatatgtatcactcatgcaaccagagtgtttacataaaaaaaaaactctctaatgtcttacctaaccctactcatacaaaattggtcatttataacctcacttggatcggatgttaatctactcattaatatccatttatgccaagacatcttatgcaatgtgtgttttttcacatttgaatacactttgcatgagttgagagttgagaccaatattattcattttttttgctaggcaaagatactccattaatagaaagactggaatagagcacaaggtgtacccacatcaaactcgaaaaaacaacatacatagataataacggaacatactcgaagagtatcacaagatcaatacatatattcctatttcacactacctgctactctatatatcacttttattcagagttaaaaactaaaatttaagaattaaaaatttagttaacctctactttatatatcactttctagtttattcaagactgatcgacaatgttttgtttttttacctcatttatttttttaatgaatagctttgtactgaaaaagaaataaaacaaactccgaaattaatcctaaatttggtaaacgctgttgtcggtgttgtaatttgtaacccagttaaatccattttagagataaagtttatgtgatctaatattatgattttgttattttatcattggatccattttaaatattttctaattcagtacaattcaaattacttatagagaaagcccatcaatatgctgattggttttggctaaacatgaaatttcttcttcatctctttgtcaagcatgagagttgtgtccgcttcagctacctttgttagatagttgttgattcttcttgttgtcttttatttcatccactaataattattatcaaaattatatgaataacacaattaatttatagtttaattattaaattaaaatttattattataaaatttattatgtaaaattatatataatattaaaaatttaatgttatatatcaatattaactatttttaatataattagtttattagtttaattggagtgttgtgttcaacctcacaagttctagacatgtatgaaacataaggcgaatcatatccataatcacaatagtatggagggaaaaactttatacacccagaaaaagactaatacaccattccagaacagtgcatttccaaaaataccctcacttttattacacttcatacatacggattcgtgaatctgtaagattcttacggatttgcgaatccataattttttttgagttatacggattggacaatccgtatgggccatacggaatctgcggggtcccaaatgaattggcttattcaaaaaaaaccccgttctttggaagatctatctcgtgtctagtactgcatggttccaccctgcaagaactctgaatcattctcttgaagctcatgctcttcatcataaatgatccgcttgtcccaaaatgacctggcccaacagggaaatcccaattcattgggcctttcaatacaatcaaatagaaagccccaagggcgccatattctaggagcccaaacaatgtgattgaaaaaatcctcctctatctgttgtgggtcgaggactccctccccttcttcaaactccgattcatatttttcatagagaaatctctgatcaacgatagaataagatccattttgaatcatatttaagggattccttggttcggaccgaagaaacaatgtcactcgatccttatcaaactcactgcaatctttttctgtacgtgaggatcccaccagagcgccttctacttctaataggccatgaactagatcagaattattctcaacgagtccataagatgtgatcccatttttttcatcaggtctgggtagagaccaaaggtcttgagcgaccgatctggcagaacaactcaaaaggtaaagaagtatcgttaatttattcatactcgttccaagttcgaagtaccatttgtatccgtatggcccatacggattgtccaatccgtaagtaagtttttttttaagttaaaatatatttttccaaataatttaaaacaatggcgcatgtaggtctcttattaacgtaacgctccaaccaactgagctaataggccaattatgctaaaaaccaattaatgttatacatgtaacactaaattttttaatgtatatttaatacacgtataagttacataataaattttgtaaaattaattttgatttaataattaaagtattttttacatataaaaatcatagttttaaataaaaatcataattttaataaaaatttgcaggactaataaaaattatatttgtatttacaggttaaattaaaaattatatctgtagtttattattgattttattaaacttatgatttttatttaaatctatgatttttatatgtaaaaaatactttaattattatatcaaaattaattgttacaaaatttattatgtaaacttatacgtgtattaaatatatattaaaaaatttaatgttatatgtatcaacattaattagcttttagtataattgatctattagctcatttggttgaagcgtcgtgttaataacctgaaggttaaaggttgaaacttacatgtgtcattatttggaaaaatattttttaacttaaaaaaaaaaacttacttacgtaaggttcatacggattcacgaatccgtaagaatcttatgtattagtcttttgctgggttataaagtttttccctagtatggaggaaaataaaaatgtgtacaaaaataatggcaatggattaatcggaccagcccaatcattcatcactcggcccattacgtagctcatcgtcgttcacaaaaatgaagcttaaccgccaacaattcctgcactgcaaactctttctgccgcaacaacacgcaacacacaaaccataaacctagccccaactttccttttcatcttcaccttcaccttcgttttcaagctacagcaatgagaaggccgaaatcgaaggagtttcgcaagcaacagcgagtttcagaggaggaagagataagcctcttgaattcatggatccagtttcagccaccggactccggttcgaacccaatgtcgctgccgcgtctccccaaaaactcccccgttggccgcctcgaagataacacctactcgcgctacgccggcgcgtcacgctttgatcaatttccactctcgaagaaaaccaaggacgccctaagagagtccaagttcgtggccatgaccgacatccagagagcgtctcttccccacgcgctctgtggccgcgacatcctcggcgccgccaaaactggctccggtaaaaccctcgctttcattatccctgtaagtgcttcatttctcagctccattctcttcggattagggtcccctgtatttctttttatttaactaatacaaatattatgataataatataatcacaagattagctcaaagtgagaaaatatatagtaaatagaatatgatatattgaattgtgatgtttatgcttgttattatttgtttatcgtggtttctgaatgcaaatattatgataataatataatcataacattttactaataagtgtggaaaatcaacatcgaaagttcaaagccatgagaagctgatacgtgtttgggcaaggtcattgatttaatatgtagtgggtgaatagatggtatattgaattgtagtatttgtgcttattgttatttgtttatggtgaattttgaatgataggtgttggaaaagttgtatagagagagatggggacctgaagatggtgttggcagcatcatcatatcgcctacaagagaattggctggtcagttatttgatgtgttgaaggttgttggcaaacaccataattttagtgctggccttctcattggtggtcgaaaggacgttgacatggagaaagaacgtgtaaatgagctcaacatattgatttgcacgcccggtagactgctgcaacacatggatgaaactcccaattttgattgttcacagacgcaggttaatataactttttttcttatatgtgatagattaacctcaatctgactctgaaattagagttacaattaagttgtttgttttatatcactatctgtttcctcgtgtctgtttttaattgtacttgggtatgtcaagattttctatccttaacaaccttcagaaaaatttgcttccatgcctaggtgatttagcaacagtggttgaagcagagtataggtgccgtttaatttttatatgctttaggcccttgtaaagcataaattttttattttgtcttccaaagtacgtgtttatttgggtcaaaccagaaaacagatatgtatcattagatttgatcaatatagctgatggttgggtggacttcccggatataggttttggtactagatgaggctgatcggattctagacagtgggttcaagaaggaactaaatgcaataatttcccaactaccaaagcgtagacaaaccttgcttttctctgcaactcaaacaaagtcaattcaagatcttgcaagactaagtttgaaggatccagagtatctgagtgtgcacgaagaatctgtgacttccactcctactctgttgaagcaaattgtgatgattgttcccctggaaaataagttagatatgttgtggagtttcataaagacacatctacagtcgaaaacacttgtctttctttcaagctgtaagcaggtaactccaactccccttttctgtcctgtttcaagaaattctttttcttgttgaagggaattgtatgttataggtttctattacaattttactgtcatgccacttgaaaagttgcaccctttgatgcttagccaatgcatggctattggctagtcatcattttcaagattttttgtgcaattggagggaatgtagtttgattttatgattgaaacttgaaagttgtctcattagtttcatattcaatggccaagtaaataattgttttgttttatttgtagctacatgatgaagttcacatgcgtagaacttctgttatggttttcagttgcgctggttatggttattgtaatgagaaaatttttaaaggatttttaggatgaatttttccataattctttcatgtaaacagggaaaatgtttaagatgtggtttttggtgcaaattccctcttttgagcttgactatcttccataatgttcacatccctgcttaataggtaaaatttgtctttgaagcatttaagaaactgcaccctggcataccattgaagtgccttcacgggaggatgaaacaggaaagaagaatggcaatatattctgagttttgtgagaagcgctctgttctcttctcaactgatgtggccgcaagaggccttgattttaataaggcagttgactgggttgttcaggtgagtctcatcctgcttttggtttcctgtcttggagcaagttttagggctttgtggtggggtgttggaagcaaaaagcttgtttttatgttcagtctctcacttctctcttgcatttgtaggtggattgtcctgaaaatgtagcttcttacatacatagagttggtcgtactgctcgatataaatctgatggaaagtcagttttatttctgttgccttcagaaattcaaatgctggaaaagttaaaagcagcaaaggttccagtgcattttaataaggtacattttccctgcaaattaatagtatgcatgcaattccaattttcatttgaacatcaaggtgtcacttttaaatctgcttcacttcagtcttatgtttgtctgacatttgctttccatgtttttgcaattgttgattattcagccaaggcaagaactactgcaaccagtttctagtttgttggcatctttactggccaaatacccagacatgcagcatcgggctcagagggcattcatcacatatttgagatccatccatatccaaaaggataaagacatatttgatgttatgaaactacctattgacgagtattcagcatcattaggtttaccaatgacccccaaaatccgttttctaaaccagaaaattaaatctaaagatgtgacaactaaatcaactttagttgagccagaggattcagacaaggaaactatctttgaggtttccaggaagaagctagacacagttgctttcaaggatgaggaaaccgaaaatgatattcttcagttagcggatactgcaaatgaaggtgaaattaagtcatctgaaattgaagaaataatgtacgttcccatatacatttttacagtggtacagattaaaaaattaggctgctttctgataatgctgcattagtttttttatatatgattatggcaaggggctacactagtcttctggtttcaaaattgctgagacaaattgatatttgaatataacaccttatgatgtggctaatagaaaaaaaattcaaacttagtgttgggtataaagttggatctttcatatttcttggcgggagccattcatctggagctttgaatttcttcctccattattattcttaccaatttagttctttcctatgcagaccagcaactcgtgtattgaagaaaaagaaactcaagattaatgtacacaggccacttgggactagggttgtatttgatgatgacggccacacacttcctccactagccaggatagctgacacacaaagtggcaaagaaatgctgctcgatccaggtattccatacttttcaactgcaaactgaagctgaaggtgaaattgttgcttgtacatgtgtatacgtgtcatttcgttccttgttttcatagttttgtgaaaataataaaaaatgttttaaaatgttaaattatagctacacacttgtttaccaattggaaaacccttttgtattttctgcaatcatcattgaatttgagaacctggctagatctcattctcatcagatcactatataccattttggtcttcagagcattgaagtagctaacttacatgtatgttcttacttcataagcatggactatttgtacattttgccacatcatctttatgtcttgatgcagaacaaaaagctgaatactatagaaggatgcgagatgatttgaagaaggctgacaaggaagacaagcttatagagcgtcagcggcttagagaaaaaagaatcaagcagaagttgaaatggaaggctgggaatgcggaagaggacgaccaagatgatatatctgggtcagaagtagatgagactgtagatagacggcataaaaagagtaaaatatactttgatagtgacagtgatgagggtgaaagaaatgaagtttcagggaatgcaggtataactaccggtgcggttacgttggaggagcaagaagctctggctttgaaattgttaaattccatgcactcataggatatgcgtaattcagctggacattttgtgacagcaaaaactggtgaaaagagagcaattcctgaaacattttaggagttctgttaacaaaaaattttgatctcccaattttttctgtcatctctttcaagaaacgtatacatagaatcaatttactgcttttatttattttaactaaaaaaaatgggactaaaggacatccttgtgtgtaccaaacacgatattaaatattattaggagatattcataatagttgtacttcaaaatctgaatcgtttacaggaaaaaaactagcaccaaaatggtgtctttgccccctgttagttagagaccccaatgaagtctatagaaatgtcagatcaaatgttttgtggaaatgggccgagtttatggtctcgtacagtcgtacttattccgttgcattgtataggcgtggaagaaacttgagtgttctcccgttgcttagactgcgttttggaattaagacaacaataaaaggatatggacataatttcaattatttatgagaaacaagaactatcaacgggagcttttttggtttgaaaaaaaaaaaacttttggatttctgtttattacaactattataaataagaacttaattattacaactattaaattaaattaagggtttagattaaatacttaattacaaatcttgtcattgataatattttttacaaattttgtgtattttcttttaaatggagatgatagtaatgacatgactggtttgttgataagaaaatggagaagaaaacaaaaactccatccatccatctggtccagtcaacccatgttcatgtattttatttcagcttgacattgaagtggggcgcagcaaggaaattaagcaaaaccgcgtagggcatcgtgttaatattttaaatttatgaaagagagaaagagaagtagggaggcattggccattaggaggagtcaacgagacaagcaagccaccttctgctacttctcatccatcatgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcaaggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctacattagaagaaatatttagagattccaatgagagggtgaagcaatggagagcagctttatttgaagtcaccaacttgaatggatggtgttaccaaactgggtatgcttaattttagttgattaagttccattattaatctctacaactgctagcatagcatggcaccacttctttattacttattgtatctgtaatctgctgaacagtatgtctgatcttctaattatcgttttagaaagtcactttgttttgtttaaccgagagaaatacatgtgtgctgtaaattaaaggttctgtttccagtttcagtgtagcagtagcaatctgttctgtgcatacatatagattagtcaagcttaagtcaacttataattctgattaatagaaacaatatggttgtccatgctcgaatacccctggtgaattaaaaagacttgtgcttttataggaggtaccagtatgaatatgaattcatcgaaaggatcgtggaatcagccgtgcaagccttgcccggatatgatgtttttctgagttttaccggagaggatacccgctatactttcacaggttttctctataatgcctttcgccgagagggattcaaaatcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtacgtaatgcttttaattagttacttaatatatgcttccctcttaagtgatattgaccatctatgaaatgctaaacatggcatagttcttgtccgagacatggggtattgtgtgttgttttgtttggagcagtttttgtattttgtacggcaatctgttagtgagaagattaattagtcgagcttaatattgttgttttattgacataaagtctgattaggagaaataaagtgaacacagcggatgaatgtcttaaaagaccttgcacttttgtaggtaccaacatgaatttatcgaaaggattgtacaaaaggtcattaaacttgaaggtagcaagcatatagcaaatcctttccttttatccaatgacagctacgaggaagaatgagtgaaagtcggtcaagtatatgctgtggagctgtgtgactaattgattgtaacatcaataactgcccttgaattcagttgtgcctatcaatgttgtttttacatccagttcaattcctaaggtttattgtattccttctaaatcttgttcaattctcgaggtctgttgtgttttttctacatcttgtttcaatgttttgtgttgattagataaaaaaaacaagtggtactattttgttttgtcatattggcattaggtaaggcaccgtgaaacaaaatttaaacacatcgccttctactcacaaaaataaaaacagagtatacaaaatctatggtaaggttaaataagttttcatcattcatctatttcagaattccatttttaattctctcaatcttctttatccaattttagtctctattttttgaagtaagtttagtctcccacgttaaataaaaactatcaaatacttatatgtccaacaaaattacatgtcacaacacacatgatgtaatcatgtgacaccgatgtgggtgatactaacatgtttagtcacatggtatcatgttttctatgtctttagaaatttttgaaatttaaattttagttcctaaaaaattatcatctttcaattttagtcaatataaatttgttttatttaatttaagtcctttaaaaaaaatttagtttttaatccttaattaatttttttaatcttagtataattatgctttagtgatttgttggtcatgagttcgaatatgtaaaaagtttatttacatatgcaagagtaaggttgtgtacaatatctttttccttatttttgtataacaaggagcctatgaacaatgtgatacataatttttttttctagtttaggtatttctagaatatttaatctcttcattattcaccttggtatcacaaatatcatcacaagtatgttcaaaccattatttggttaggtcctacattttgtcccaattttggattggatttttcttcctacaccagctagtgttcccatacacccaacaataaaatgaaaaactgaaaatacccttccgtaaggttcatacatattggccaatccgtatcctttgttgtcgtcaagctcagtgccctcccagcctttggccaactcaccgacatcgtcggggtccccacctctaaccgcatggaagagaaggcccactccctcggcatccccctctctatcctcgaccacaatccccacctcgatctcgccatcgacagcatcgacgaggtcgatgaggcgatctgtaatccataagattttacgaatttgcaatccataagattcttacggatttttcaatttgtatgaaccttacggattgtcaatccgtatgaatcttatggaagaatattttttatttttcgttgtctttggtgggtgtatgaagaaatttgtctagtgcatgaaaaaaaatgcttatggatttctgttattggaggttcattttgagctatgactcttgcactttatttttattttgaatagaatatacaattaataatttctatatgttcaaagtaattggatccacatttagacaattatattttttttctctctatttggcgaaaatattgtgtaagtttataattaattagaatttaggttgaaactaattattttatttgatgtggttacttattattatatattttaatgatttcatcgtattattaattgcttgtgatacaaagttaattaatagttgtgatgtaaagttaattatatttttgcatgcaattaactatatctaatagtaaataatttttagtcacagtaaaatcaactatatttatacatacaatataatttctgcattctgttataattgtatttttaggttgttatatataaatagttgaaaaagaatgataattttatatcatcattaatttatttataaattttattgtctattattaatctcataagagatataaataaaaaaagataattaatattaccttaaaataataataaaataattattttgatatttttttcttgtgacaattataattagattaaggaaataatattttttttcaagtggtgatgaaatgcacaaatttgagtgggacaactataattttcgaatagaaaatggagaagaaaacaaggactccatccatgtattttatttccaggaagcagcaaggaaattaagcaaaagcgcgtaaatgatagtgtcagcacatcatataatatcttatgttatctgcttaatagtttcattgcgatggcggatgaagggggaattgcgaagtggcgctacgatgtatttctgtgttttagaggggaagacacgcgccacaccttcacaggtaatctctatgctgctttgcggaaggcgagattgaggacattcttcgatgttgggttgaagggtggtgaccaaatctttgaagctattgttcaagcattggaagcatccaggatttcaatcgttgttctctccaaaagcttcgcgtcttcctcgtggtgccttgaagaacttgtcaagatccttgagttaagggcaacaaagaagcaactagttattccaatcttttaccacgtggatccctcccatgtaaggaaacagactggtagtttcggaaagtacctgattagacatgaaagtcgcttgggaaaggactccgagaaaatacacaagtggaagtcagctttgtatgaagttgccaccttggccggatggtgtttcggagacggaagctgcaggtatggcgttttttcttcttcttaatttagctagtaccgcttcttaattttaaaaaaagaaaatgaaaataataattttttgtaggcattcaatactgccttacactttgagagaaaaaagaaacacagaacaacgtgacattaataagagagataatgaaaaataaaggtgtaaatatgtttttaatagtttagtgtttttttttttaatttttgtaatttttttatttttagtctttataaatatatatatatatatatatatatattttacttttagttttaaaattactttaaatagtactctagatagtaaaaaaaaaaagtcctataagaaccaaaataaaaataaacattgtttgtaaggattaaaacaaaaaataattttataaaaacaaaaaaataaatattaaattataagaattaaaaagatatttaagttaaaaataaaatgtttcgatccaatgaatttttagcctaggatggtgtttatgtatcattgttgaaattaaaatttcatatactaagttaagtaactcatgccgattattattgctgaagtcatgtaaacttgcattttaatcctcaaagaccaaaaccacttgtgatatttgcacgaagcttttttccttgatttataccttattgaatattctaacttctgagttgtcaaatgactcgttaacatgggcttgagccagtttatgtctagaattgcaaggctttggccaatattcttaaagtgacaatctaacgtaactagttaattctcctttcattcttaaaagaaaaacaaaatagaaaccaacaataattatactctttgataaggaatttgttttatgaattatcacactagaatttattattggtaagaaacaatctaagcttttagctaatttatcaagttaattttactttgttttgacttacgagttttaaggtttgaaatctttggggagattaattattcaaactcaattttattatattaaaaaaaattcttttaagcactctttattaaaattataaaatttatagatctcactttttacttaataattttcattcataatttttaattaattgtaagaaatgtgcaagtgtgtgagagagtttcttgcttgaacccgtcttaaagtaatcaataatagataaagaaaaacgtaaccagtgcatgaatgaattaaaaggtcatgtacttttttgtaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaatcaaggctttcgatcattgtattttctgaaaactatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacaacacatattattcttttactttttgcttattttcatgattcatgtctattatactagtaatagttgatgataataatcacttaatatgtgcatcgttcttgaaattctatgaaccgtttaatttgaaatccgttcatttaaatttgactttgttaacaaggaataacgttgtgagagacattggggtacggagttaaggctttgtttagagtttgcaattctgtttttgttgttgtgtggtaattacttttgtgcggatttactttgataattttagaaagaaaatgaaaattgtgtatgaatgaactaaaaggccttgtatttttgtaggtacgaatatgaatttattgacaaaatcgtggaaatggccagtaaaatttaaaatggcttaaatcgatcaagccctcgctcaagtgtcaactagaaggcagaactgatcaattcaacagattacagatggttctatgagcagtcattagctcacaaattgatagtaatagtcgtaatgcttacaatcagcactgaggaattgatttggaagtctgaattttacttagaacattagcaatttctagaaaggtgaatatatatgtcctgagggccatggccagaggcctgtcatcttgaaattgtgacacacactctcgtttaagtcatatttactttgatttcccacatgtcatgcatatacaaataattgtatgagttagattaaagaagctttagcattaaacagattgaagacaattacccagttaagatgctgaatgatgtttttgttgagaatcaaccgacatagttattcgtgatgtatataatcgaatttcgtaagacacaccaaacatatccttgcatgataacttttgattttggggtgtatcccgccgggaagatattcaagattgtgcagtgtaacaaatacccttaaaaaatgattaacgcattatgattttagttagttaatagtaaaacgattgctgcaagtttaaaaagatttgaaatagtttatagtattttgaccgtgaaattttgtgcttgttttagtcgacacaatcccatagatatttgagaaaaaggataaacattttctctgaaagtcttgtatcttcctcaataggtactgtaccataggttaatgttaaatttttaacatgagaacaaactaaaagtatgtaataaagagtaaagtgcaaattgatcatagaagaactttaaaataaaagagtattgacgaaaataaagtgcgcaaaaaaaaagatacaaaaaattaaaggagtaaaaagtttggagaagaaattgagattgaaaaaagatgaagatttaaagggaagtataacaaatgtaaaagaaaacgataaaatgaataagataaagtgctgaaattaaaatgtttgagagtattgtaataattcattgatccacaagtgtcacgatgagacaagaggatatgtgagtgtttacaagtttcaactcttattacaaatttttaaatcttcctcatcgataactttaatattcaatgtcaatcattaatgtcctttgtctttggtattcgtttttaatatattcttcaagaggtatttgtagatttttgttcctctaatggttaaactcaaatgctttatgaaattattgcttaaaaacatgttattttcccgtgtcaggtgacctctaaaaaagatcaagctcaatactgggctgattcttcaaagccatataaatttatttcagtgccggagattgcataagcctttaaaaattccagatttggaaagtcggtagaatccatgtgtactgctccctttaataaattaaagagtcatccttcagctttgcccagaactagatttgttgtgccaaaatgggagctctttaaggcgtgtttctcgcgcgagagaccttgatcaacaggcataagtttctctatatttttaggacctgccaggtatgtatatatactcaagtaaataaggatgcacttgtttctatatatagttttcaattcttaagtttttttacaagtagaattcatgataagttagcctaatgtttgtgatttcttggtaccacttacagaatagttgtcagtaaaatttgttggaattgtcacatgcacaatgtttgtgcaaacaaaatttcatggtaaggatgaggaatatggcaatctctatcaatctgcactaattttcggactcatacacatgatgtttaatggtcattctgaattgtcactcatgatagcgtgtcttttacaaacagagaggcaatttattttatcctggacaggcatgctctttggccacttgtattcttggtgtaccttattcccttgttgaagctatagtatacaacacaagaccatataacagcttcaacaagggaataaggtacaccaagaatccaagtggccaaagaccatgcccgcccaggatcaaataaattacctttttgtttgtaaaagacatgctatcatgagtgacaattcaaaatggccattaaacatcatgtgtatgaatctgaaaaatagtgcagattgatagatattaccatattcctcatccttaccatgaaattttgtttgcacaaacattgtgcatgtgacaattccaacaaatattctgtaagtggtaccaagaaatcaccaacattaggctaacttatcatggcaaaaaaattaaaaaatagcagtttaaataaaaaattacaagaatacgacagtttcaaaagtattttgaaatctattgtagtcaatcacgtcctggctggacgtgttcaaacacgccccagccaggcgtgattcaggtccattcacgcccttcccagacgtgtttggtcacgtctccaccagttgggataggtgaggcagtcacgccccacccaagcgtgatcttgtgtcattcggcgagaaaatggtgttcttcttgggaaaacccggggtggcgctggaagacaagtttcttatggggaaagcttttcaaagtagaaagtgtcgagtaggacctcgacgatgatgctagcagcagcacacacgtgtgtgttaaggacggccagagatgccaccgtgctcgccacgaacggacctccaccgttgaacccactccaacccatccaaagcaggcctgcgcctgcaagcaccataatcatgttgtttgatggaaatatttctgtccttttcagatcgtggacccacctattcaaatcaaacaccatcacaatgcaaatgtcagcattttattataaagaaaattaacggcttcaaattattcacacaacaatgtttgtaatcctttctcttgaatattcattgtatatttgtacatataaataaaattaagagtgaaattaaattttatttcaaaagttgtttggtaatattacgtaccataatcattcattttttttttaaaaacaatatcacccacattatttatattttagttgaaacatgaaaaaatctttttttttcttctttatgcgatatgatgcgtggatatatttttacatatattttaattaggtgttgtatatgtataacccaaaataattattatatacctttcaattatgataattatagtgcatatagttaacaagatctgcattttcaaggccgtttgtttgagttttattttagtaataatttttaaaaaattttaaaaaattacaatattaatgagattctttaaattgtaatataagattcttttttaagttattgatacaatagaatatttattaactttatgaacgattaatctttgtaaaaaatttaaataattaacattagtcattaattggatacaattaactagacaaagaaccaattattgtagggtctttactcttaattcttttatacatcataatgaaattttacataaaaacattgagtctaattttatttagattaacatgttggtgtaagaatttaaaaaatatatcacaaaatttatttgttaacttaaacacaattatgaatttttatactaagagtttgcttttaaaaaacaatgatttaagtgtttattcataattttgattataaatgagtaactaagacatacgactagttatttaaatgaatttttgggtaaaagtgataagttagagaaaagtgaatgacccaataagctgcagtgaaaccagcaactccggaggagaggtgaataacatatccgccagagaaatcaataaccccaagctttgctaaccagccatcggggcaccaaatgctaaaggcagtgacggtgtacgaaaaagtaagccaaagcggcacaaacagcatccacccacgaaagttcatcctcccgagcaacgccccagctatcaagatcaaagtgatccccgcaaaaacgccctgaaaaaacaccatcgtagcagtgggaaagaatcccagaaaagcttttcccagaagaaacttgtcgtccagcgccaccccgggtttccccaagaagaacaccattttctcgccgaatgacatacggaatccccacgccatccagtgaagaatcacgcttagcaagatcacgcctgggtggggcgtgactgcctcacctatcccgcctggtggagacgtgaccaaacacgtctggggagggcgcgaatggacctgaatcacgcctggctggggcgtgtttgaacactgcaatagatttgaaaatacttttgaaactgtcatattcttgtaattttttttttaaactgctattttttaatttttttgtcaacttatcatgaattctacttgtaaaaaacttaagaattgaaaactatatatagaaacaagtgcatccttatttacttgagtatatatacatacctggcaggtcctaaaaatatagagaaacttatgcctgttgatcaaggtctctcgcgcgagaaacacgccttaaagagctcccattttggcacagcaaatctagttctgggcaaagctgaaggatgactctttaatttatcaaagggagcagtacacatggattctattgactttccaaatctggaatttttaaaggcttatgcaatctccggcactgaaataaatttatatggctttgaagaatcagcccagtattgagcttgatctttttgagaggttacctgacacgggaaaataacatgtttttaagcaataatttcatcaagcatttgagtttaaccattagaggagcaaaaatctacaaatacctcttgaagaaaatctgcaactcccttgcaggatggaagtttgaagccaaatgattcaaaaaactccagcacgtctcctatggggccttgatattcaacgtacccctctgacagaagcagaagatcatcaaagagctcaaatgtttatggtgcaggttgaagtagagccattagaacagtagcatccatttggtgaacaaaatttcctatgcattacactacttgggatgtggtagagctatcagaacagtagcatccataaatagagcttttcgtggtccaacaatcatttctcttggagaaaaaaatatgaaaggcaaaagtatgtcattgcttgctacaatttttaacttcaattagtgccttcataatgtcttaatcttctggtatagacacagtcaaaacaaatatggattgaattttgtatcatctataaattattgttcctagaacaaatatggattcaaatgtatggactgtgttagcttctctattattatatattaatttccaatcttaggagtcaaaaacaaaattctaaatgaaatctccttaaatcttatcaaagctatatttcacaaaacaagaaaaaaataagggactgaatttggaccctctttctttgtatgatacaagaggtaatccagttagattaacttaagcatatatcactacaagagccaaatttcaaagaaaattgtaacaaattcctagaaaggggagagagatcacctgttgtaactctcattttttgccaacagagaccccccttagcatatcattgcccacaaccgtatctgaacatacatcaagaccaaggcactttcaaaacataatctgtcttaacattgtggtttttgccaccaacaagtgttctgttgaggagtaaaatcagtttaaaaaaacacaaattagaggacttctcttaacttgcacatatgcatgatttttcagatattatttacaagatgaaacaaccttcatgaatgcatcaatttctggacttggcagtatgtttttctccttctccaagcgttcaagatttttcacaatttctgttcatgacattagaccaggaaattaagtaactgaattctgaaatggaaaataaaaataactaaaaatggcacataaggaaactaatatattatatacatatctatatcacttgaaccttggcatctgtttgcaaaatcaaaagtttgtctcactgtcagttctgatatgtgattatcagtttggctagtgtatgcaaaagccctttgaatacagaactcgttttgctcatggccattgtatgttatactaccacttttctgcacaggtatttaaggatcaaagttctaatgtaattctatgatgacaatggaattttgaagaatgctatggcgtatcaaaattcttggtatgctgacaattcagaaatggacttgttccagttagataaaggctataaaaatagaatcaatcttaattcctattggtataatgatttaaagcacattggtttcagtgtttcacttgttattgtgctataactggaatacactaacaagacgatcattcatgtaggcacaattttttactcaattcctattctataaaaataaaaaatgttgactaaataaggatgccctacgtaatagcttaatatttgtttcaaagaaccgaaaggtacctataatattagtaattacaaattgtaaagtaatacacgtatataacccacacggatgatggttatagagtttaatttccatgaactccaaaatttaaattgtcaatcaattatgaattataaagtagttatcgtaaatatcaactaacttactttatatgacagtttgtaacttaataacagtgtaaaaatcctgtacataataagtacatacaatatttattagtcataattaaattaatgttaattattagttctttaggaccgtagagaatgttaatcctgcatagaatttgtactaccttgaggttgctttcaagtttcctgcaagagccaaaagtaaggtagttttgcccgatcctggagttcctaacagcaacgtcatcctacacaacaacacataacgttaagcttgatattcattacgatataaacatatatgaaactctggaattttctccatagaaaaaattctattataaagtaattgagagagagaggaggtgggtaaagagggtggagcacggtctttataaaattagtagtagttgagagagagagggggtgggtaaagagggtggagcacggtctttataaaattaaaagtagttgagagagagggggtgggtaaagagggtggagcacggtctttagttgttttgactatactttgtattttatattctaaattttaattattaatgttatttttttataataagttttgttaataatgttaaataaaaattaaatgtatttaatattttattgtacaaaattaatattttaatttagtgattaaaagtattattaagaaagatgatgtaaaaagatttaaaactgttggatgcgtggaagatgggtgttgctgatcaagtgcagaattcaattcaccccgtgacccgtaacaaattaaagtaaattctgcagtttctataatggcacatgtactccacatgcattctcataaagcaattattgatatatcatttgaaaagactccacacgatttctaacagggtatcaaacgaagcttcattaatattcatagcttagcatgggttcagcctggaaggaagacaagcccaactttgacccacttggtattttaaaaaggatttgatgatgcctatggtatgagtagtgtagcgggaacaatacaaatattaatctaatatataatcagcaagtagattcttatagtcagtatgatagctaatttattataaataaataaaatgatggttgcagaatcttcatcttaaaaaatattaatgtttactttcaattatgaccatagatatatttatatttttttttaaactaatattttttttgaaattttattgaggatgaaataatcacatatataatataaatgttatatacaattagtttttgaaaatcacatttaaaacaaacaaaattcatatataatgtagaaaataaacttaataaataattttatagcattttcatcatattattgtttgataagtcacctaatgtagcgtgcacttagtgtaacatgaaagtgcactgccattatttgattctccatccataaactccgctgtcaaacgtaatgagtaagtctgtgctatgtttgacattaagcaaaatgttacaaaattaaataagctattatgtcatactaaaaggtaactaaatttcagagttacttaacaaattatataattgtccaactttaatttgattaaaaaaaaattgaaacaactaactaatcaatatgttatgttggccttagtttggcacaccttgtgttgttactaagtgttctaataatgtataaattgcctttaaaaaaacaaaaaatacgtcatgtaattataatttaataattagttcgataaattacattttatataaaattataaataatataacctgaatcttgttccttggaagttttccactaaatggaacaattgtgtttatagatccagtcatattagttttaaagctacacgtgtctatagataaggagactactctgcagatcagttggctaattttgcagttctcagtcgtaattatttttgctgggtttcagttccccctttttgctctcaccgttatgcccgtaattttaatgagctgctatgagttttgttgatttggctatggaccttggtctaatcctcccatattttgttttctttcttcctttgtatataaatttccgttgggtattggtataaaatcttagaaaataaggatgtcaatatagttgtgatattttttatatttttatgtcttatccgtcctttttaagaattatatataacttataatagtgtatgttttgatttcataaacattttttatagtctgaaaatcaaaagttaaaacgtgaataattttttaaacttttacctggccactttctacgtaatatatttcccacaattcctttcattgatcatacacgaaccatttttcaagactactgaaaaccttcatccttaaaatacttgattttatgatagaattaaaaattattataaaaaaactgatgtgacagttgcctccatcaatttatcagtttcagattctttttgtaaaagaacaattaaagttctctaaaaaaataattaatgtaacaacacgtacctaatttttaaaccagtcatcaatgccacaagcaagcaggtacattgcttatccattgtcttacttcctaattccactattcttaatacggccctaataaagctaccaaaattatcaaccattattttataaatgaaagagatacaaaaaaaaaaaatagaatacttttcaaaatataagagactgcaagagtcttggattaaatttctctgggaatgtagtatgatattaaaaaaaatatcaaatttcaaaataaatcaatttaatcctatttttatactttttcttctctctttattattacaaatattcctcttaaaagcattatgctataaatgattgagtgttataaaagttgaaccagaaaaattgaactttaacctttatcggtatatataaatactaattttccttaattaaccacaatttacactggcctatcgattatatttcttgtttgattacatatctctagctctttgctcatgtcacaaccataaatactgccctcctaatcttacatcataggtattgccgaaggctttccccactcagagactccatttcctgcagaatttcctgagcaagagatttaactgaaagctccacatcctcaagcagttcgccaaggaaggggattgtttcagctatgaacactagatattcttctttcaagttctccacaaaatatttaacaattctgaggcccaatattttagctcgcaatttttcactccgtgtctgcatcaaaacctgcaaaaaacgggataaagaaggcagaaagatattcagttgctaaggaatactagtatttgcggggaacaaacatatagcattcaagagcaacacatattactgaatacccaaaactattaacaacaaactaatggactaaacttcaacacataaataaggcattgatgactacaaaggaccaaagctaacgtactatgaaatgggatgcaagagtacaggagcaagttcagatctttaaagatcattggccggtagggtaggtcaaaaccgcaggcgtcaattgacattattactaaagtttgatcaaaatgacataaaagctacagtctatttacaattaaaccttataaagcccgataaacatagcagaaaaggtcaactctaacatgactgaaaccctgttcagataaactattcaataagcacttacagaataaggaaaaaaagagcgtaaaatgaattaagcttctctcataagttaaaataaacttttatagaagttctgatttagcttctcaaaaaacttgttttaattcacgttaatttcaacttaagaaactcaatccattttacctacttattttattctcttagaagttcttgttgagagttttcccaaatagtacatgattttactatgcttaggtgatgttgataggtagttgttagcaaggccacaaatggaggtctagcaaaggaagttttggtaaggatttgctcgtttttctagtttgaatgactaatgttagaaactccacgtttgaacctgctggcatttctaggagcccatttgccccgtccagcttgttggcttgctgctgcaccacagctactgactgaatgtttacatgtaagaggagtggattcgttaaattaaaagttttggggggccatatctgtatttacacttttattatggcctttagagagttaattacttctactgttagacatattcttaatctattgttaaaatgtcttggggcatccatgcacccaaactaatagggagaatagtagaaccagtcatattcataacagtgtttcccgaggacaatgatcatatgcattttccctcaatgaaaaacaagatagtgaagccagtaagttaccagtatgtcagtatcaaattacttgcccaatcattaacgagtagtaaaaatgaaaagaaatcataaagttcacctcatgattcaaaggtttccacaaaaggtcagatctagcagtcactgccatttgaccgatgcacacaaccagtaggtcatcaacttccttcacacttagtatatttatgctgtcatccaacagagctggtggatctacaacaagttgtgaaacaatgggtctcaacaacatctgcagcaagcatgacataacagtcagtgagagaatatagcaagcaactatattactgaaggaagctgaaagacttaggaatattttattcctcaatggaatgagaaaacatgcaaagtatttttaaatggaaaggaaaaattcccaattaatgcataacctttaaaaaattccactctaggtggaaaaaaagtcttctaaagaattttttcataaccatttcaaatggtaaaaatagatattgatgcccatgcgatacatatatcagatatgaaaagtatctgacatgactgcaattattctaaaaatgtataggataggataggtataagatataaatctagacatgtaaaaaaaattctgcaaattcaaattaaaagcatacttcctgcacattatttaaaaagtataaatcatcgtaaatcaagtcctattaatctaccaacaaaatagtatcaatctcattacttttttgagatcatccataaagaggatagtttccattttggtgcatcaatggacaatgcttcaatttttatacatgcttctatgtctcaatatgtaaactatattagattttcatatctttaaaaaggcttgatgcttcacagacgcgtatcagtgaagtattcaaaagttatggtatcggatacgaatagatgaaaaaatgagttcttagtatgtaaacaattcacttgcctggaaatttgaggagtcaagaaacttcaaggtcccagtgtcgtacaagaaacacttatgtaaggatgacaagactagagccctgagatgccagcccttgatagacacactgcctatttcttttatattgccatcatctagaatcctggcctttttcttccgattcactctagacacttccacatctacaccatcgctaagatgatgaacacaactaccaagcaagtgtttgaagtagggaacaaacaatgacctacaaataaggatatagaccatcttaaactgctgtgatttgatcattattttgggtaaacaaggtaacatcataacaagtgattatattcttatgtttattggcataaacataaaaaataattaaggaaatcaaattgaaaactaactactgatttaaatactgcgaccaaattgtacaagtctcaactgtcacaagtggttgacatatttacagtggttcaaaacccaattttcgtatctacatcacatgtacataatttaatacaaacaaaaagctaaactcttcttctgagaatacaaaatatacccaaaatatttagaaacccaaataaagtgttgtttgactaaattcaaagcatgcttatttcaaagaacattttctaaagcgaacaataactagctaactaaatactgacttaccgatggctctcagtaagcttatttaccatgccatagaatgatatggccctatcaatgcttccgctggatgcagtttcatccacttcagattctgcccactcaatactctttatcagaagaggcttgaacatgctctcagtaagttttaaggttagaacagtcattgtgttaagcacacctttttccactacatcaatgttttgaactgaaggaggactttgacggcgcagatcaagagcaaccaaacaatggtcaaatatctttccatggaatgccacaatagatgatctgtccattgtaccaattatggttcccaacatatcaaatacaattgttaagcttttatccccagcctcaatggcagctgggtataattttaacaaaggtggcagggcaagtcgaacctgtaaaaaaatagtgattggtaaagaaaaaaatgggtatttcatttcataccacaattacacaatgctacattataacaagtcttacaggaattttttcagcaagaagctttcgtactccatgagctctagactccacctttacatccattcctgaaacacattcaggataaagcaccagaagctccattatatttgtaagatacggatttaaaaatccaccaagcttgtccacaactgcctccaaagtgatgagaacataaaaatgggattcatttaaggctgataaaacatcggtggtttcgggtttcatatccaaactagccaatacttgacgagatgacttcatcacattgtccataatcttgggaagttctgccagtgattttggacctagaacattgatcagggcagcagttgttctgaggcagctagaagtcacagccaagttatgagatgcaatatgtcttgtaacagatccaaggcacagactaaagatggaattattcgaaggaaatctttcagctagaacttctaatgctgaaactgctgccactttcaaggaggtatttgatgaatcatcaagtactcgaataatttctaaacacaatttattaagtgattcttgagaagtttcactcatatgaagcaaaagaaaacttggagttgaccttgaacctttattgtctttaagctttaaactgacatttttatgatttcttgcagcctcacgtaacagcccaagagcctgcagcacaagaaatacaaatatcaaatcacagttctcactgtcttgctttcacaccacaaaaaagatgtggatttctataccgtgctcatggtgtgcaaacattggaagactcttatgtttttcgatatatcaatactttcttttctattaaaaacttggggcgtttacttgcacttctattgtctgttttctttagtcacaaaaatgtcaccttgttttcaatttgtttccgattgtcaaatcaggaaatggagggggaaaaaagtttttagcgcttcctatacaaataaatgaaaacaggaaacagattgaaaacaaggtggtatttttgtaattaaaaagtgaaaacagaaaatgaaaacaggaaacaaaagtgcaagtaatcacccccttagtatttttggcttcttattgtgcgctcatgctcacatattaaaaggcaaataaataatttaccaagatgtgtggtcaataccaactaaacaatttacagtgtatatagaaccaactgtattcataacatgtgaataaaacccaatcatcatatgaaaaaagaataaatgaccactgtgtatacagtatacccaccaaattaagtacacatcttgaaaatcaggatgtttaatagaatactatgaagcagataaatacaccaccaaattgtagtttaccactttacccttgtatcaaaataatacaagatcctaataaaatctcatattttgtaacttcattaaaaaccataccttttttccaacattcttgtctgcatggcgaagcaatttaattatgctctcaaagtatatgacaggtatcataactgttgttagattccttgcaagtgcatgcatagtttctttcaactctgtcctcagaattacagggaaattcagttgctttttccttgcatctacaagttgcatgagtaaaacaacatgctccataagcgcacccaatgccctctgaaatattcaagaagcgatcacatttatttttattatgaatatgttcatctaaataaacaagagaatataggcttattcaaagattagaacatttgcaaaacaaaaaaaaaatataagcatgcaacacttatgccattgctatcacaataagaaaccaaaaacagcatctcaacattaaacctacaaagaaaaaacaaaatatgacatattctacaaagaatatttcagttcaggttttgataatgaatattgttggatagttgtctaaattccagtcacacctagccttagttgtggcctctttgggggttgccttaattgcaacctcaagggtggtaatttagtcccacatcaactagacatgtggttaaatagaacttatcaagcttgggcagtcctcaccttgcaagccagtttggtcgggttgaattagggccctaagtccaatttctgataaatatgttcatctaaaaaaaaacaagtgtttataggcttattcaaagatcacaacattaacacaaatataagaagcatgcaacatcaatgccattgcactcacactaaaaccaaagacagcatctcagcatgaaacctacaaagaaaaggaaaacaaatatgatataaattcttctacaaagaatgaatatttcagttcataatatgaaatctgcttctgcttcgatatcttcgtaagatctgtccctcaccttaaaatcacaatttctgattgatagaaatttaacttcatcatgtgtatcatactattttgtcaggcaaattacattgacaccccttaaacttacattcaatattttttttttaccccacacatacctccttcaattaataaatcagggaagatatatgttaatgataggatccaattgcaggctatgggaatcaagttgtacattagaagtatgcaattctagcgaggtttataaggcctcgggctctctaactaagtacaacggctagcttttgtggtgttgctctcccaaagttcttatcaattggtatcaaagctttccaccatgtcccttagcctgcacacaagcagcaagggtggtgacgccacattgcagccagtgggtgtcaacatagtatccccaaatttatgagttaagagatatcaacatctcaaaaacatactgtatgtatctgctagtcattattgggcatgggtcaggcaaaaatagaagctattcataaaaatcataatataagttacatctagactttgccttatagaactgaataaagacattaaaaagcatacaagtatctagcatgcatctgatatggatttatacctgaatgactgaggtatcttcacctgatttcaacttaaacacaaattctggatcttgcaacttttgcaaagaaaattgcattacaataaacaattccagaaacattgcctggtcaacatcactatttcccctctgttcaagcagtatgactaaagaaggaagccaaatcgtacttgtatattgttcacaaatttgcactgcaaatttatattcccactcctcattataaaatgttaaaacatcttgcatctcaacattaaggaaacaggcagctttccttgaaattaatgaacggaaaagtaggataagcaatgaggctaagcttttaccctcacccaaagttctgcaaaacagccatcattataagacacaggcaaaaaaccgatggctgaagtatcaatagcaggatcatgatgtagaagtagaacaagaataccttaatagatataacacaaatgacagccttctgtgctcaacaatttcaggcaatatattcatgaaaatctggaggaaaaaaaaacatattagtaggttgaactgctaagagattcttttgtatcaagcagcagaagatcatttatgtgaaaaacaaaccttcagtaatttctccacatcatctgtcttagccagccaacacggaacaattgcagatataagatcctcaaaaacatgcttcgaatgactgtcaatctacaggcacacaaaaaagagaaatgatgacaccacagttcctacactggattattagtccctaataaattgaattgtgaagaatttctattaaatactgcaactaaaagttaagttgcaacagttaataagtaaggtcatccaacaattgaggtaggtgatgtaggattttccagtttccacaccccctccccttccacagatgcctgctgaccaagtgatgcacaaaggaaactcggaaatgacagaaatggctggaggctttgataccatgttagatttcatcttaaaactaattggcattaagtgaggttgtccgacaagtataaaaaccacgccctagtaatcgaggtaggagttgtggaactttccaacaagcatggaaacataagaaaaggatgtaataagctattctacacaaataacattgttccccagggaagaaaaggatctaataagctactctaccaaaagaatgccctaagttcagtacagggaaaccctgtattaacaaacctgtgtgacagctgcttgtccaataacttctagaatatcaagcatatgctccaaaacttctcctggaaagactctggtaacagcagagagaacagaaaatacatggttgcgggtgactgcaactgtggaattccgggcgcactctatcaatagcttaatgttaatttcatttgtcattttttcctgtcaacaatggcaaaacttaataatataaggaaatagctaaaatagtgaaaaggtagtcaaaataatatttctaacaacataataaattttccagcttcacaaggcatacatttaacggatccatgcttttaagagaaataattatatcctccaggattatcaacagagtctgttgaatatgatatattgtgtaattgttggcttccgaaggacttgaaggttggcttaactttatcttcggggaaaaggcaccattcacccattcttctgaaaataccttgctaagaagcttaaataagggccctaaaagtaaatgcctgcaacaatcaaactgagaatttagcacagttaaatgttttaactactcatctcagcagtacccataatgtaatgttcagattcagaagtaaccaagtcacctgtttgttatgtccttcttcagtagcaaaacatcaagaagggaactaaggatgtagactgcattaactcttctgaatatgtcattaggaggatatcctgcttcttgatgtcctatgaatttttgtttcttcaccatcttttcttctgctgaactacttatacaactcttctgtgcaagtataagatcaagcatgtggccaacagttgagaaactaatctgcaattccaatatatccaccaattattcttaatttcatttcttttttttccttccgtggaataaaaagttggaaaaaacctcccatacaatgaaaagaaacaacaacaaattcttaccccacaaggtgagattggacattgaagagcatagtgcaaaacaaacaacaaataacattgatagtgcaaaacaaccagttgatccaaaaaggcttcggtcagataacaatggaatttacattgttaaaatttatcctcaggtcactaccatattaactgtttaaggatttttaaaagaaaacatttatcttatcatttaaaaaaatctacaatcaattgatgaataatgacatatcatccattttgtcaattgatgaatttgaagctaaacacccagcagataatgatgaaacacctgtttcacagtgaaatctgctatcaaataaaaagcaaggaacagaacagaacagtgacacagataacggaggatagaacacaaggctgccaagttcaacagccagaaaccatcacggtctgattgggaatagatggaaatactgccatagaaagagagaggccatgatttgtccagaatcagagagcacaaagctaaaactacggagctcattaaccacagtaaaggggaaaaggatccaagatccacaaccccaccccccggaaaaagaaataaaataaaataaacacccttcttaaagggatgaaaaccccaaaggtccagattgaaaaccaaaagattaagttctttgcaagtaaccactaaagaaatcgcacacagaacacatgatatttgatcaagagcaaggaactcacatctatgcacattaatgcctctttagttgcacgttgtacatcaccattatcattatgccacaaaatcacgagctcacaaaatagatgctcctgacaggcataagaaaaaactattagtttaggtcacagtaaaagctacattggtgataattattttatttacacaatgaaacagattatcataaactcattaactagatcattagctatactcatcaattatcatgaatgacaacaacaaactctgaaaataaatagatatactgccaataagaccttcacttcattcttcaacttcatatagaattgattgttaagtttgttcaagacagtgatacaaggctttacacaggcagggtcatctgatgtcatgccgcccaactgaaagatcccaagaatgaagtcagtaaattcaaaataacaagacatgacataagtaaaacacacatcttaatatcttacccgcaaagctttcagtaaaagatgttgaagatcatttccaccagagggagatgacataacacagctctacgcatgaagaagaacaagttcacatcaaacctcataataaagatcccataagctaaaactaaaatatacaatacacatacctccagcaaaaggcacattatctgagtttcagtgtttgacaactttggacaagacttattgagctcattatagtactgctccagaaaagaagacaacaacggcccaacttctggaacgtgcataagggcattcccaattcctttgaataaggataaaatcattagctgcatccaacatcaacaaataagttacttccttaaagtctcggcatagcacaaaaaaccctcacttaacactgttaatctggaactgaacatatgaaaccttgatctgtatctctatctccacaactaaaaatataatagaaacatagaagagcgttaagacatcaaaccttcccatagttagagaatttaagagtggaacccaaaatgaagccaagaatttttatttttgtaggctggtcaaacctgaaaagatatgtttgggaacaaagtggaataaagaatcttagaaattagtacaaatgaacatttttaatgaatgaagataaggaacattcttgaaaaaaataaaaacagaaactaacaagcaaaatgaaaaggtaaaagtaagatggggaaagttacaagataagactcacagatatatgcatcaaacaatgagcgtaagtatcagaaccaataacaacagaatattctaaacctattctatcccaacaatcaatctcaataacacaaaacagcagcttaaagtccactaaaaaggtaagccgcacaacacgtaacattaaacaaacaaaaacactaaagcttatatgtaaagaaaataaaacaatgttaaagtctatatgtgactgtacatgatgtgtcaaattttatattgccaccaaatcctacctttcattatcctttaatgctttcatggtgacccaaaaggatcgcttcgggacgcttatgagattctagtttataatgtcatattttcatttaattaatggtcgctggcttctttgattgtagagagtctctactagagacttgtctttatgtatggtacataaagcaactttgcctgcttgaactttcttaggaagagagtatatttacaattagtatttttgcaatgactccattcatggctatatcttcatagcccaaaaggaaacactagccaagaactcttatcacaatctcgtcagcactcagcaaggaaaaaagaatcaaaagcaataaaaatacaaaggccgggcccatgtagcaggaagagaaaacagttaatcaagtgattggttcagtgaatcaatcctggccttttttagattaaaggagaaggaaggaatagggtttgatgttatataaaatttgacacttaatgtcaattggtcatataatagagacacatacacatgcacactaaagcctaaggatgcaatttaataaaatactccaaactagtgtcatattgcttagtttggaatttatcataatttcttgtttcaagtttatcgaagaattcatctagaggaaataaataaggacaagaagaagataagcaatcattctagaacaaccataataaagaagtagaacaacacaatagataaaaacagctctcaagtgaaaacccataattacaaaatttataagcaatataattgattagcatttgtactaagttaggattttgaataaacaggttttgaataaaaataggatcattcaactgtcaagttaaggttccatcctacagtttatgcattggttcagtaccattttaattctcagctgtttataatatatatgtatatatatatatatatatagtcacatttaacattgaatgaacctcctagagaaccctctatgccatctacctaaatttccatttctttctcctcccacccttaaatttactttccccttccctgtatgactttatttgtgtcatgcatccctccaatccttatgaactttgagttgttacaatggggacaatgaacagcaacagaaccatcatttcccgtgacaaagggaaatttactgtcagttgtcaaacattatatcatttagattttaaaaagaaaaggggaatgctgctctccacatttaagaagatctagctaattccaacaacagaacaagagagcatggtcatatttgatgagcagcagctaaggcaatgaatataacaaatagttctaaggtaataatattggtgacaatgaaatgataattgtcatagtaacatcataaataccttttttctatattttgaggtaccaagatatttcgaggctccaagatgtttggacaggatgagctcatagcagacgcaaacaatgagggaagaaatttcttgtcagacaatatgaatgttttttgctgatccatcaacgccaaaacatcacccacaaaatggatccacattgcattgttacctgttcatatcaatttagaaacttataaagttccaaggtaaaattaattaggcattgagggctacatcaaattattctgacaatggagtaccatttttctttccagaacgctcaacatgacaccacaatgtacgcaatgaatcgatacagttcaaggcagcaacccttatagtctggaagaaaattcaaaacgatgcaaagaaatcatttgagcacattttctcagaaagaaaaaagccaaaaaagtaacagaggataaccatttgtcaacaattataaattggcagtttgcagaaaatgagaaaaaatacacacaaggtcagagagtaacgctaacaaagaatcatacctgattatcactcgccaatggaacaagaacagaaggaaattcagctaaaagttcaatttgccatttatcttgtgacaggctacaaagaaatgcatagcattgaagactttcaacctggactgcagcaggaacacctgcagaatgaaagattcaaccaaaaaatatcaaatatgccaattgaattttatctgacttctgattcataaaatgttaaaaatatcaattcaaacaaccatgatttcaatcaactccctccccctcccccccccccccccaaaaaaaaaaaaactataacttaattgcatttgcatagatggacgaaacaaactggagttgggcttatatgtagtaatgcaaaaaatattattgctttagactggagtcagacatacatagatatacacaagctcttttgacgtgagataaacctcactgactcgaccgatatcttgatctgctttggagagaaaatgtgatggaataagttcttctcatccaagtgaacagaaatcatgtccaagaaagtatcaaaggagcagatgcaaggatcaaaggagtttttggtggaggtgctttcagatttaggataatatcttagcttttaaatgaatttgaaggggaaaccattgatgaacaccaaaatacagcgtttgataccaagttagattttaagaaccaaagagaaagttggcaagagagatttgagagaaaaagattgttctagatctgaaatcaaaacatattcaaaagtgtatcacctctgaatctgttacaatagagtgaacccataactgtctctaactaaaaactggcagcttacttctgactgaatacaagtcaaacaagtaggatacagaaagcctaacacaaaacagccactttaacacctaaacatggattggtcaggatgaaaatgcccctaacgggggatggaaggatttatcagggatatacaaaataattgaaaatggagtaaaaagaataggaaaaggagaaagaatggaaatagaaagagaataactacaaatataaattttgtaccttctaaacagcaaatatgtgtgtctgcgtgtattcattattatgcatgagagatcatgataattacagaaaaaatagttctattctctccctttgaaatacgaacattttaggagaatagagctcctttaatgattatttttccaagtatcctagatacttggtatagtcaggatcaatgcatcttaggaagtagtggcatctaaattgttctcttgttaaattgtttcggcattgattatctttgcaatattgttgaatataaacagttcactctactgggtagaaaatacaatcaagtacattcagaaaattttctttctcattttctacaccataacacaggcagtaatttcacagtagaaggaacacaacattggccaagtaaaatatgggaaaaatcaaacaaaaggaataagtgtatagcaccttcttctgtgaaaaacttagataagaggcggggaggtgatattctgcactgcgctgctaagtaatggaggtgttcatggaatgcatgcttcaatttagatgaagcaaaaaatacaaacagatcccttatcttgctgacccacttatcatcgtcatgctgcattttgaaaaaggttaatatccaaccaatgttgacggtgagagtctaacaacaacaaattccaagaaggaaagcaagttcataagacaatagataacaggattacaaatagtaaaggaattacttacaagcagaatgtcagaagttagtactgatattagttgtgctagcctccaaaatatgcaaatcataagcttcacattaagatggctcagcttgacatacaaaagatcattaaagaatgcactgcaatcccagtctaacacttcagacttgaactgcaaaacaacccgaattcccaacaatcaaaacagaagtaaaacattagcttctcattacaaaaaaagtaaacaaataatgaaataaaagcacaaatatgctagtaaatcctttgtacctcatccaatgagacatcaccagctgtcactgacgtttcccactcagcctttagaataggaaatacacattcaaatagtgcacaaatgtcttcatctttgatcaaaaggaaaaagtcaatatttatcattccttagtcccctcttgaaattttttggctaagaaatctaatagagaagacaaaagtacaactatgggatgtataagatatgcttcaaacatttatttctagcttatttgttcaaacattacttgtttttagtcattatacgatataagattattaactatttctgaaaaatattaaaatggaattcaaaaagagaaggggaaaacaaaccttttggttttatcaaaagagactgcaaaagaacaaaaaagaagagtgtctttgacaactccaaatcactgcagctttcaacaaaccaagctatatgctctttgggatggaccatgaaattcttagccatgttatcaatagtcttcaagttaattgaagataaacttccaggtatcaatgtctgcgattttacttcaagagtcactaaagtaaaagatgattgacaatttcatctgacataaacatattcatgaattgttgtgattactgattaacaacttagaaatatgatgaaaccaaaaatatctttttagaaaacccacactacaagtactactagtaagtagtaacatatcatgttcatgtactagactattcatggtgcaattgggttattccctacataatatctgtaaaaaatgtgcatttcaaatttcaaagttttggttttccaaaggagacaggacctaatgcttgattcatatcttcagttcaccttggaaaattctttataggatcttcagtttgacaaatttgccttgttgagcaacagaattaaatttcttcatattgtaagtgtacgttaaatttatagcaaactaattccaaagtagatatttaccccttctccaaaagaagatacaacaatattctgataaagtggccagtttattttgttgacaagtcccaaagcctttaaattcaagctctgtgtctgcgcatggcaaaataagttattatttgataattacccagagacgggaaaatctaaaagctattaaataagtacaagatcaaaatatattaattttctatccgaaaaacaaatattaaatatgatgttaaccactacctgtggtagaacaaggagtaatggaaaaatcatagcagcaacattcttcaagtaatcagcatgatcactgaagtaggagatggcattctttagacaagtgacagcaacttcaacatttagactatagttatcagctgaacctacaagaagagaatgggtgcataatacatgcagtgaattaagagcataatttttttttattcagttatgtaatcctcccacccaatcttgggatagatgcatcatcgttgaatgaatcattagtaaggaaccaagcaaagaccatttgtttaaagaatatctaaatacaaacatctctgggaagccaaattcatccttatccatggttacaacagaactgaaataagtttacttgtcaaagacaggaaacaactagccataacttaatgaggacaaatatactccagtaacagaagcacaactggaataagtgtatgaaatgaaggttatatgcttatatgtatctagtcaacataaagtaaaagcatattttgataaaataaacataaaaatggacaaccagacacccttcaaaaagaaaagggaaataatataagttcaatagagtaaatcaatcccaaaatacacagaagaataagcataagcatattttgaaccattggaaacacattaaggaagcttagacatttatgagaccacatctgtattctgcacgtaaccccaccatcccctaacagtcatcaatcatcatccatcaagaatgcattcaaagaacaaattccttttcccagtttatggataaatcgatgcatggtatgtattgcttcaatacaacatgcagaaacaataaagatgatatctatctaattatttttaatataccacaaattacctgacagcagtttgccagtgcatctttttagcacattctgtagtgcatcaagaagcttagaagaatctattacatttcgcaagccatcaacacgtaaagctgcttgaacaactgttagatctttatcatcaagctgtcttaagatgtcctcttggatgcttacaagattctgataaaaaagatgacttttggggttagctaaaggttgaagactttgaatatggaaaaacagtattaacacatcctagcaagaactttgaccatattataaagatttccctaagtcaacatgaaatcaacccataatttcacataaaaacagcataacccacgtgataatcaattaatttatggcttataaatataattaattatagcataccaagtactaaataatggtaccattggtactgagtacttcttactagcaattggtgtttgtgtttgacaatgaagcatgatgcaataaatttttatagcattttccaccaccacactttcttttggacagatttgtgcccttgagttcatcgtggttcaaggctcagtttacagaggggtttcacttttgcattttgacagtgttgtaaagatatcaggtttaatattgagttctgtggtcttcactttttgctaagcctttattacctggctcggttcaaatgaagttgaggtggcttttgagggatatatactcctccctccttgtacacctactctttcaaatgaagttttctaacaaaaatcaattataccctccctcaccaacaatgtgtaaaatcagtggccttgacaaattagatcacaaatgcatctcagttcaaatcattcaaaatggaacttaaatgtatcaaaaaatatttccaaataaaactagtttgacagcaaaattttgtaatgcaaccatttcctaaaaataaaaataaaaaatcaaagagaagtaatatgccaccaccatcagaaattacacacacttaaagaggaattaatttacaccgttgtaaatcacacttactcttacatcattatgaaatgtaatttttgccaactattgaattataattatatattaccaaaattatctatgtcaaatcttctaaaatatgaacaacaataagaagaaaatcgaatgggtttgattttatatgtcagaagtatatataacattaattttgaagaactgaatgatgtataaaaaaaattgaattaatctaaaattctgtagatatgataggaacttttaatccaacaatgggtaacgagataaatttatccaataaaaagttactgaatgatgtaagtgttggtaccaagcaatcacacaacaatcgagagagcggaaagagaagaaaaggaagaagaaaataacacgtagtgtttacgctggttcacccaatgtgggctacgtccaactattctctatattttcctcacacactcgttacaatgtactcagattacaaggaaatatataggtttagggtccctaagcatagtagctattcatgggtccaagcccaaactacaaataataaaactcaaggtcaacatcagaaaacaatccctcattgtgtgtgtgtgcaaaacagaaaacacatcaagcaaaattttaatagttctgccacccaaaaagagaaacatcaaggctgttcttcaaccagtgtcataaatgaaaaatacaaatttcaaacatgcagttttgggaggacagatatataaaggaaataaaccacatcaagcaagaagtttcaacttttttccaaccaaaaggagcacatcaaagatgttcttcaaacattgtcataaacaaaaaatacaaattaatggaaacatgaggttttgggaggacgagaagattaacagagcatatatacctctgaaccaactgccttggttttcaggataacggaattatttaaatcaagcagcgtagcacgtcgaacatcagcctagaccaccatatcaaatataaatcatgaagctcttacaattataaaaaaattatcattgttgaacaggagaatacatacttttatatttacatacacctaataatcaagaataggtcaacgattgatacctttggatgatacaggcccaaccaaatatttgagtctgaaataccaagtgacgaatccatactcccatccaacatcttacataaaaccttatacaatgaatcatctttcttagaatgcctttattatcctgttgaacatgttcaaagttcaagccattatatactatctgacaatgcatgacaacaacaaaaaagcagacaactcatcagcatacctgaaggaaatgatgagcagcacctcgtaattcagaagggtattttgtattgacaacaaacagaatcttttttgcccacccaactaatcaacatttggcaaaccaacattatgagaataataagctaggcaacaaatgataactgactagttgtagatttctagtaaaaaagataaaggtaaaccatatggagctaaatgattaaaaaaaaaaaaacaccataagaaaagaaaacaaaattattcaggagcaaaacctgacaataataatttacacagaaatcaacgaaacttcttcaaaagaaatttgaatttccaagctgaagcaagtaaaacaaagtacactgactaatgaagacataacatgcatgcatgatacacatagacaaatcataagccatatagtgagatacacaatttgaagatatctagttcattagagggtttgtttacaacacaccaaatttgttttaaatcacttattcaactgctttaaagcagtttcacactcaaacttggccaaaacagagttggtatcaacaaggattgttagcagcattaatgtataggacagtagtatgtgcaatttcctgtcttcataagtatctttcatggtctctgggtttctttataaatctatttatttacagttgaaaaaaaagagtatgtagtttcttaacaaataaaacttcccttcctgaaggcacacattagacttcaacatcaaattccaattttcttttatcagtttcaacacagggttaaactgttaaagaatggagtaagattctttgaaaacaaggcattgtaaccagcgtaatccaagagtttggctcttaattgagaaatgcttttcatactgtagaaatggagagtgatgacagcatttggtataatgcaatgcttttgttctggtgtttcaaacaccagttcttactatttatacagtctggacaaacattttattacttacataatattgatatagaaaacaaattaactgctaagtaaaccacttttaatatcatgtatctattgcatgtttgaaaagttctgtgtcggggggaataatttccagataagctgccaaaaaaatttcttcgcctccaaaataagcttatacaaacacaaagtaagatcttcatggtgaaagaaatttccaagtaacttaaaatgcatccatggtcattgctttcagaattcagaagaacattttcacacaggtattcaaacaatttttttacagaagtttagatgagatttctcaatcaccaaatgagattttcattaaatattattttcttcagaaatttattgattcactcttggtatgaattattagatcaaccttatgaagcacaccaggatatataatttggggtacaggatagtgatcagcattctaaaattcaaaatcagaatacacacctgacatggaagaagttgagtcgctaactttttgtgataatttcacacaatttgaaaggatcttggtgaccacatgataaacaagaccatgtacggggactttttctattaaggatagcaaagtccgctgacagtattcatctgaagaactgcaaatgtgttattgttataatcagcataaaacacaagcttctataagatatgacttaaagcatatatctcctgaaagacaatcataggaaacacacctgcagtcaatcagggagtccaaaagcacgaggagaaacttttcgatattgaactccttagataattctaataaaacccctgccaggtccctatatgaaaagggatttaataaatcataaatataaataaagaaaaggcaacagtcaaagcacagtgattatgcatatgatgagaagttcgaggaagactaccttatttcctttaatatctccaaggccttcaatgggagtatttcaacattttgagactaagaaaattccaacagaacaaattaaaataaaaatatagccattcagaaatagatattgcacaatgaaaggaaattggatgaaataccaattacaccaccccccccccaacaaaaaaaaggattaatgcctccgtttaaaccatacacaagcacacaggattacactagtacctgaacaagactaattaaggtaataagggacaaccgaaaccaatggagatctgtcaactctgtagcctcctgacgagcaacctcggcaaccaaacgtatcaaactattcaaaagtttaggagctaatgcagttttgtttccaagcaaaccaatgatcataagagaaccagcctgcaaatagaaaaccaaaaaagaaagcacaagaaagtgagcttccagctgctaattgtaaataaggacaatttgacaacaaaaaaaatgcaggagagggagccaagaaacatagctcaaatacacaagtatacatatattgttggaatatgtgaaaatattttatcatatgttagagtatcttagattatgttttaggattagtcttcctatacttccattatctctcaggattgctctatgattaacataaataagagttagtacttcggatttcatgaatataccatccaagacatggcaattcatcgtaataatcagtttttttttttttgatcagcaaaagtatatattatatatatgagaaaaaaggatagatacaaaaagaaagcagaaaacagtccatgataacaaaacccagcctatggcacactaatacatagaaaacatgaattaaggtgccataaacaggatggacctaaaaccccccagacaggtgagagagattaaacagtcccctgcttacaaaaaatatccctaaggttgcaagcccaaacgtggaaaggcatgtgaaagcctttctccaaatttttgcaccacaaccaacataaaaagtaaggtcaaataatcagtagaatatcattcaaagcttctattctcttctttaactccctctatacctaaaaccccataatttcaacagatcaaataagcactaaaagtaaggtcacccagtcatataatcatattttatgactatactaacataaaaaattatgcactactattcctatctgtgatgaataatattacactggtggatattgtagagcaaaagagcaaatttatttcgcagtctaccatttgatagcaattacattgcctactaatgagaaggtaatcacaaaaatatgacagtatgatacccaactataatcagttttaaaatttaatacatggaaaataatttcctaggaagctaaccttgtgatctgaaacccccttaatgccaggctgaagactcacaaagggaagtatcctctttacaagatcatcatcaacagtcacaacagtacccaaaacttcaacgaaaacagcagtacaaaagcgaattgcaggcattgaaggtcgagacttttttgacggagatgcctgtaaccaaatccttagccatataattatttgattccactagagaacttccacattcacaactaaacgcaaaacaattactcacatagttgcatagagcgtctaatatgcccttatcacggatgcactgctgcactatgaccattctaggcagccgtgcaccagaggctttcacaccatcaagaaacccccatttagtattccttcacataaattaacagaaacatcagaagcctctccaaccagtagtagtctacatcacaaccaaaccaaaaacacataataatatcttcctaaccttgtatcaagtatctgtactattcgaacaaattcaggctcgtcgtggtacggcaaagcacacaaaatcaaatcctcgttgttgtatacatgaatcctgaaactcaaaacaaccacatcaaaaatcacaaaaaaggtaaactaggcagaggcaaaatgtgattatcaacacaacacccctaggaagaaaacaattcataatacattgttgaaagctcacttgtgtctacgtatcaagtactcaagcgtttgaagggcggccgtatgaagaaaatatccagaaagtagtttcaagtatgaagcaatggagacattaagttgattgttctgttctattcccatcaactctctatccaactctatacgcctgtggttaaacaaatcgttcttatggttcctgaaccgctcatccatgccaataagaatctctaagcctgaaatattgcatcacataagaaaaacagaacaaaatcaaacgaaaatagaatataaagtagcaccgtaattcatatgtattaagaaaaacccaagtccgacgttgtctagagatagtgtcaagatagagtatataagtgggggataatcctcaccctatgagctagcttttggggtagggttgagttaggtccaaacccatattctaagaatatgctccatgttaatcactgagaaattaattcggtttactggattgctttagttgcactagctatgttgaaaagagcgaaattaaaaatgagaagattgacctcgaagagcttcggtgaaaatagcctcggtggagatgtcagccgcttttttgggatcatacaagatggaagggcgagtgagtggcctcttgagagggtcagagtcggttttggcgaaggatctgatagcttctaattgcgacgctatggaggacgccattgctagggtttcgtaccaaaacgaagcttaaacgtttgattttggtttcagttttggttcttctgcttatgcttcttcttgctgtctgcagaacttaaaagtcaagagtgtgagagaaccaactgttatattgatttacggctttcgcgctgagctgctggtagggtttagggtttttgtgtttaccaaccattaatgtcccttcctaaacgacgtagttcctctctctaataaataacaggctgaataatggtccactttaatcaatatttttatttaaatataaataaatagttaattttttatttgttcttttatttatttatatgttatttaatttaattataaaattttattgaaatataaatataggtagaagtctcaaatcgaataaatataaaaaagttaaacattatataaataaaaaaaatacttataaatgtgagttttaaaattttaaattaagatatgatattaaatttatttatataattttaataattcattagtataaatttttttatgtttatcagacacaaaataattaaaattttatctcatactctaataattttatttttaaatataattacaatctattattaagtaatctgtatcctatgatttgaaaaatatattagagatatataaaatttataataatttatctttaaaatatataagtaattggttgtgcaacaaactcgtaaaataaagggagaaaaaataaattttgaatttaagaagaaaaaaaatgaaagacatggaattttgaaagaaaaaaaatcttaaaatcattttgtcttatgctttttctcatttttttttaaatattgcttctattttttctttttattttttatctcttactctttaaacaagcatacaatttgagtaaataattagcaaattaactaaattcgtatttttctaaaatgtaagttcatatctttaaccaaatatacagttagacaaacttcaccaaaatatattaaacatacaaagcatattgtttaattcatcaaagaattgtgtatattagaaaattgggttttctaatgttgagttaaatataatggaaataaaatttgagtcaatggacccaatactatatattaaaaggacaagactctacctttgtccagcataggtgcacatggataatttatgcgcacacccacatgattaagtttgaaactctcaacagtgaggagattgttcgtaatgttattgatagtgatttattgggatggatttggacatttttatgtttgtaaccttcattaataatttttataacttataaaaaagccttatatagtattaaaaaaaatacagtttttttatgaatttttcagcataaatttggataattttataagatttttttagtataacactcaacaaattattacactaaactcttgagattttctaatatttttttctttttttattgttgatcaggcttttcttttatttaatcacacataatatatttttcttttcgttaaaaatgatatacacattcataaatttcttcataaaaaacgtcattatgataatgaattttcaattgaattaacatatgattcattattttcagtattatcaattaacaaatatcataaatttaaatttttggttcaaatccaattgcataaacaagaagattttaatacagataggcttaataaattatgtgaagaaacattaaatgggaagacagaataaattaactattaatataatggaaattttatattggttacactcttttttatctaaacagtaacattttttttattgaccctaataacctataatgttttctaaaaattcagtgaagttattaaaactttgtaaatctataaaatcttctcaaattttataaattaatatgttataaatcttttaaaattcaaactacaaagttttaatcataaaaatatttttacaaaatcttaaaattcactacattcatccaaagtcttgtaaaatccaaaaggtttattataccaaactaatattctaaaatcctaatttaatacctatgtagcaccgactccgacacgcgacacgtgacacgacacgactcgactctccgacacgtcaatcttaaaaaattattgatttcgacacgttgggacacattttaatattaaatcatatttttaatttatataatgtatatttcatttaatattcaataacttaacaaaaaaattaaactaaactaataatatcaaattattaggtattaaaaaaataaaaatagcacaaaaaaaggttacaagattcactggttcaatctcaaacatacatcaaattaacaaattatcaagtattaaaaatataaaaaaagcacaagtcagatacaagattcagtttcaaacatacattaaattatcaagtattataaaaataaaaataacattatatcaaagattcacagtgaaagaaatatatcaaagaaattaggggttcatagatagaattaaagaaattgggggttcaaataacacaagccatacacaaggtcacaagcaattaaaaaaatactgcagaatacataaatggtttttttaataaaaaaaactaaaaagagaaaacctaaaaaatctaagctaatagcaattaaaacacaaccacatgtccacagtcaccttatctgtgtgaggcacgaacggcggagagaagagagggagagaaggagcgcgaacggcagaggaagagagggagagaaggagcgcaaacggcggaggaagagagggcgagaaggacgcgcgaacggcggagagaaggaggagcagcaccggtgacgcgaacggtggagagaaggaggcgcgaacaagaagggaacgagaaggaggcgcgaaaagggaacgagaagggaatgagaagagaggaacgagcagagcagtgtcggacacggtcaaattcgcgtgttggcgacggtcaacgagtcggagatgttgaccgcgtgtccgacaccatgtcggagcatgtcggtgtgtgtcggcgtgtcgggtcgtgtccgacgcgattctgcggtgttttgccgtgtccgtgcttcatagtttaatacatctgcagtttttatgttgtatttcctcattttatttgtgttattaagtgattttgtttaaattaaactgaaataaatatatttgtatggtatagtatcatgttttttttaacattttttcttttagtattgagaaaattaattaaattaacaaatattatttatttatatttaaatgaacaatgaaaacaaaaaaaaaaaatattgatttcagattttaaaggaataaaactcatagaaaactaaaaatatattttaattgttaagaaaattatgaaagcgtggtttcgttttatctacgaaacaaagcggaaaaagtgaggcaacgacatatttggtgatgtcatgaggatgggtgatgatagaaacaaagattgaagcggaagtacattgttgtctcagccaggtagttactgttactgttatcatggaactcaaacaacaactgcttcttctgattctaacgcttctttttgctattgccacgcctgaatacgttcgatctcttcctcgtaaaaccttaaccatcccatgggattcaatttccaaggcccactcctcttaccctcaacaggtcaatcaaactctttttcattcatcatgttcatattcataaataaatagtactatatcatcacccactttgtgttatttatttcccacttgatcaactcacagtacctgatttctttcgtattttgattggattatgttgttcagttgggagggttcattttttttttatagggtgatattttcaaaattattctctatttcaagttgttgactttaatttctacgtagaataaaaaaaatcatattgttaatcattcagaaatcgtctttgatatgatttttaagacagtgacgatgggagcatgtctccggggttcaagatatagccctgcacggtttctttggttatgaaattcaaagttgatccaataattttctgtcactcttgtattggatttatagttcatgatctgggttctagtcacaaatcttcaaaagacattttttattcgttatggttggtgatttcttatagtatatatctgtacagacaatgattattatttatcagctaatattatgtaacttgaacagtttgtttcgctttctatgaattatttgccaattctaggacaaatattctgtgaactgtcaaccgtgcttcctctattaagcaatcatatcagcctctttagttagtcttttatgcatgttcttttatggtgactattaaatttcagtttctttgataccaaatttttgttccaggtacacatttctttggcaggagacaagcacatgagagttacatggataaccgatgataaacattcaccttcatatgtagaatacggaacattgcctgggagatatgactcaatagctgaaggagagtacacttcttataactatctgttatacagctcgggaaagatacaccatgccgtaattggccctttggaagacaatactgtgtacttctaccgatgtggtggaaaaggtcccgagtttgagctcaaaactcctccagctcaatttccaattacttttgctgtggctggggatctgggtcaaactggttggactaaatcaacactggcacacatagaccaatgtaaatatgatgtctacctgctaccaggagacctttcatatgctgattgtatgcagcatctgtgggacaattttgggaaacttgtggagccgcttgcgagtacaaggccgtggatggtgacagagggaaaccatgaagaggagaacatactattcttaacggatgagtttgtgtcctataattccagatggaaaatgccatctgaggaaagtggatcaacttcaaatctctattattcatttgaagttgcaggtgttcacgttatcatgcttggctcctatgcagattatgatgtgtactctgaacaatacagatggctaaaggttagttgatctcacctattgatcaagagttactaaaaattggataagtgtaatccaatccatgaccatggaaaactacacaatcatgcttgttattattatttttatttgtcttttttacactactctatcattttaaaaagaaaagtactttggagtttggaccactttttttttcactctttaatttttactcatccctcatctacaggaagatctgtcaaaggtagataggaaaaggacaccttggctgcttgtgttatttcatgtgccatggtataatagtaacaaggctcatcaaggtgcaggggatgatatgatggcagcgatggagccattgctttatgctgccagtgttgatttagttatcgctggtcatgttcacgcttatgaacgttcagtatgtctttatgttttagcattttattttctctgtaagcaccatttagtagaaactgggttttaatactctatctcattgtcagaaacgtgtgtataatggaagattggatccctgtggtgctgtccatataactattggtgatggaggaaacagagaaggcttagctcataagtaagtttcacagccagaaacatcccacagaaatctgttttctgaatcctttattatgtgaaaaaaaaaaaaaaaaaaagctatattgaggtttatcatgtatgcagcctgaaatttgtttttccgtcattgttgctgcatgtatccttacataattgtttgttgacaggtatataaacccacagccaaagtggtcagaattccgtgaagccagttttggtcatggtgagctgaagattgtaaactccactcatgccttctggagttggcataggaatgatgatgatgaaccagtaaaagctgatgatatctggataacctctttggtcagttcaggatgcgttgatcagaagacacatgaactcagaattttgacgccctaaactcagaactacgtggattagcaaaagttatgtaaatattgatgattagacaagtccttagtttagtttgtatcactactagcagcagagtgagtaaactgaggtataaggctagttgtcactttgcaagtgatggtgttgcttgttttgtctgaacttataagattggtttctgatttctatatagaaaactaaaacttagcgtacttaataaccagcaataaacatgtatgttttatattcttgactgacattgagattttagattatgattctagagtcatgcaacgagtaaagccgtgaagattactgggattcacgaaggtctaattaacaaaatgccttaaatctgaaatcattgttcgctgataccagggaaatgggatatgatagaatgtaaatcagcaatctaagaatagaacggtaaaaacagcagagtggataattaagcattaagtggaaactactgggttggcctattctgtcttgaagtactgaaactgatttatccaatatacatcaacacatgaaatctgctaaatagaatctaattacatttatgccatcacagtgattttataaagtgtgaatacaaactgagttctaaacaaatatctgtatctggtgaatttaggcaggtaacatctttccccttcctcctctcttttaggttttgtttctccatgttgttttgttaacaattaactctatttcacatcatcatcatcatcatcatcaagtggttagaaaatgggtaactttggcactgtcagtttctgctgaggtttctgtaatcattaatggtccagcttggtgcttgcaacgtctcttggcttgaagttgaaatcagcaagcatgagcagccatgattctgtccaaaagttctcggggaacatgctctcccctactttcttgaggagagactctagcaatatgcaatcacataatgtcttccattcagtgtaaacatgtaggtcaggtcatatagcagtagtaacactacaaactgcaaaattgtcttgattctaaagacatcattcagtgcattgtccaatcttaaaaatataattgtgctaaaacatcgatacaaattcccaccctcttagcatagttcaatttcaaccagtaactgattgctttatctcagactgctcctgtccttgttcagcagatgtggcacagcaataatctgttaagtttcaataaactcattggagtggagttctccatgcatatcattatacagataatccactgggattcccatgttgtgttttgcatgcagggaaaggatatggaggcaaaaaaaactcttacaagtttcatggttcataacttattgccaatagattctattttgggttgaagcaacttcttcgagttgttcaatcaaaagaagaaaggacctcaacaggaaaagtgtttgctcagtctctcctctttacagcgtctctgatctccaaccatggactcaaaagtatccaagagaccatccaaaccctcatgattcaactccccaactgccttcaaggcaaatacaatgctttcaatggtggacaaataaccagctttaggctgatgtctcacatcactatataagcttgtctcattcacttccaacttcacgtgtggcaaaatgttcaaccaaggattttcactataaattctttttgccttagcccatgttccatccagaacaatcaagttcttcacctcaaaacctatagcatccaggttactaacatcaacagccttatcagagggaaatagtagtaccgatccaggacgaacctcaagctcaaattcatcacattcttccaatttttcatccctattcagttgcttcctctgaaacttcttcaccaaaaaccctgttgagagtgcttcacaagcttcagggtacgccaaaatattgtcaaagcttaacttgggggattgacattgtgcttgagtcatccaaatatgagacaaagagctaatggcaccatatttgccaatggtaacagtaacagctagctttccattctcttcatgtacacctctagctaaatcacactttagactaattgcatttttctcaacttcatcgttcaccacttcaccatcactgatactcacttgtttcacaacttctacattagaagcagaatccagaacatctccaacatcatttctcaaaccacattttccagcactatcggtatcaatcaagttagaatctatctcagaaagcaatttctgggtgtctccaatttcccaacactggcgagaaaacaatgcagttggctcgtttccagcatgaccggaatgggaattcggatccaacaaccgaattaggaaccgggcttcgaaattaacatcagaaacagttgcaacggtgagattcttgaggcccaatatagcgattctggtagaattgaggggatgcttacgctctagcgcgtgctgtaggatggttacatgcacagaattttggagacccggtgtgaggattcgagagcagagacacgttcggctgggtttggaacaagaagggcaaatgggtcttttagattggccctgttgcattgtcgacatcgaaatctccagggctctccgctgaaagagcttgtggctgtgtgaagggttgaacctgaaccaggtgatgctccggattcgggtaccaagaaaagccaccattattagcttgggctgctaccaaaaccctaaaacggtttgaatagggatttttttttttttttttttttttatgaattttaaaggataaacaatatttttaattcctaaacttttttcaactcttatagtttttatcttcaatatttcggaaacgggtcttggatcttggttcccagactttttttcctttaatattttggtcctttctttgtttccaaaagagtttaatgttgtaagtgatgacgtgatattttttattacttttttttgttaaaaattgtaaaaaattgtttggataaatttttttatctttttattaatatttattaatgatgattaatttttattaaaaaatttatctaatcatttttaatgaatttttttatcccagtcaaatattattcatcaacatgactcaaattaaatactttatttaaaaggattgaatttggtatcacttatatcaatgatttaataatttatttgaaaaattttaaatatattgtaacgacttttaagtgttataaattgttataatttgtttgaaacataattaaatgaaaatttaaaaatataaaaatgtgagttttttaacttttttttttgttgctaaagtaggttttaaaaaaattacttatataatataaatagagttatgttcaaaactatttatataacatgaattgtttttgccatgcaggatgtgttttcttgagtaacgatcaatatatttttttacattaattatatttagaatcgatgaaatttgtttttttaaatgttgtaaatataaaaaagtgtataaccaaaactagaaaacgatgcctcttatatgctaaaaaataaaaaattaacacaaagtaccatttggataacactttatcctaagtgacaacccgtaacatataagtaattttaaaactactctatttagtttgtttttcttaaaacctatttcctaaaaaaaatttctcgagaaaatttacatgtgagtatcttaaaaatgatgacattttgggatcactataaatgattttatatatttcatgatattcaaattgagtttcttaggtatcttggattagtgatgcccttagaccaaataggtgtcattgtaatttattaagatttaataaaaaataaactccttttataaaatgaattttcttaaaaaaaaatataacataacagtttaaaaaaatgagacggtagattgtgggaatgattcttaaggagcaggtggagggtttcgtggggtgttaatatttgacttgtgcattccacacgctcccatcgtcacttcccagttccaatctttcttccgattgaaggcatctaaggagagaaaaatgcacgatttctgcttcacgattccgtacggattgatgctagtgggtggtggactgttcgcctacataagcaaagggagcatcgcttctctcgccggaggcgccggctccggtttgcttctcatcatcgccggctatctcagtctcaatgccttcggcaaacgaaaaaactcttacctcgctctctttctagagaccggtatcctataatttctttcctttcattattattattattattattattattattattattattttgggtgtgattgttgacctggctctcgatgattctggatctgaaacgtgttctatgctagaatttgttatttgatggaaagatgtggatatttattggattcattttttcggattgtatgaaattctggatttggattctctctcttaggatgtcatggtgatatttagattagtaattccatgttctcctaaaataatgcagctcaagtatcgacttatgaaaactttaagatgcatatgttgttttaacttgtgggagaagtctgatctattttattttaccctctggatttgcgttaggtgtttgttgaaatgtttatcgaaactctgcctaaatgctctttgggtttcaaagatattgaatgatggtgctttttcatttactactttctattgaaaggaaggggatttgttaggttaggttaggataggttaatagggtgtctacctgatggagggaaagtgatacatagatctgaaagagggtgtctgtgcacaatattgaatgccaaggaagcatcaatgaatgtatgtaacctgatcaagatatattgggtgcatggttttcaaatttccattgcttatttatcagacttggatcttgccccatacacttttgtcattagtatagttgatgaagtggaacatggtttgtcctacaagactataactagagctttttgctttagcttcgaatataagcccatgttttagaatataatgataaatataaaagatcaaaggagggggatgtgtttgtaacaaatattattcgattgaaagtaaaatttcttgacagaatttttttgatttaaaatgcttatgaatataacaagtttattatcattaagttaatgacttgcattgctcctacttagtaataaaaagtatgcacagaaactctagcaggggtatagatgtatcacattgcattatcatatgtcaaaactcaaaattaagcaagaatattttagtaagtcataagttatactaaattactaccaatatatataggatcaatgagtatctctgtgtttatactgggaatgtatgtctgttactctgtattcatttgataagctatgatattaagggggtcttgctctggttgagcaagggtgcatgagttgttgtaaactccctgacattgtcttcgatttctatggataaaaaaaaaaaatctgataagccatgatcactgagttaattatggtccatattagccggagtaattttctatgctttttttttctaatttgtatactgtgaaacagcttgtgcagccatactaacttgggtcatggggcagcgatatttggaaacatccaagattatgcctgctggtcttgttgctggaatcaggtaatcaaaggattgattagaagtacccaaactcgttgtaaacatagttttacttttactctcagagttgtaagaactaaatttaaacttttaagttttaattgttggataagttgttagtttgtagattataaatccttgaacttgtctttcttaaaagtaaatgcatccatgaaagttctttaaactctttttaaaagatcaaggcttcaccattcccatttattttgagaataaaagaaatatttttatgtgccattatcctgaacttgttttctgctagttctaaaatttgtttttaacttcccattactgatttgaagatctatatattatgttctgaatttgaagtcaggaatcaagcactggcagccattacttagtttatgttttgtgagtttgtccaattgctccacatcagtcacctgtagtttgtatatggagttaagatatttgtctgtctttttcttgcagtgctctcatgactctgttttatctctacaaattagcgactggcggcaaccatctccccaccaaggctgagtgatgatataatgatatatcatatatttgcttactataatacagatatgttggttgatctgcatgccttagatggttaagatatatcattgtactttagtgatttcaaagtatggaacaatgttgtgttgtcgttgtctttatacacgtaggagaattgggccagtacttcatcactctctaagcagctctttttattttctactttcctttttctcttagcttagcacaccttatcactgaggttgcttaaattcaaaactggctcttatttgttgcatactcgacaaactcgatggaaattccaattgaaatttatcaagcctttttatttgactggtcaacaaatttacatttcttggtgtgagtctactttaaatatggaataaattacattgtcaacaactagatcaggttctaacgcgtgcctcccaggaattaaatttttgcttattgcattagctaatacttgttgtgcttatctaaccatgaaattaaacttgtgatgaaaattctttaaaatataatttgtaaaatcatttttgaaaattgtgttttgaaaaaaagaagggagataaagtttatttggtgaggctgttttaaaacagattttaaagttagaaaacaaaataagaattaaataaaaaagttaagttttattgataaaaaacacattatcaaacatttatttattttcaaaattagaaactgttttaaaaggattatcaaataagtcctaagtttaaaaaataaaaagaaagaaaatagtgtctctccccctttcttcctaccgaattagccaatttcctctcattttcttcatctttccatgtttttcattgttgctttgattttgattctttctaagttccctttaaaattctaaaaaatcttttgagctccatatattttgttcccaacccacataactttgagaagttttttttttttttagttaaggatagcgtcctaagaagtaaaataagctagttattgctcaaaaatgaaaatactacatgagctctttgcggtatatccacaattcaaatttgagaaaaatagttttgatatgttttcaaatccaggaaaaatatatttatagctttgagtaccaagctaaattttatttataaacatattgttaaaacatcttcaatagtaacgtgggttaaaatagatctcacaagttagcactttttgtattttttaaatgggtctaattagtcatctcttaattatttttaatggttaataactgatttttttatacataaaacggaatgagctcatattattgatgatgaaagaccgtataaaataaggaatatgattataatcatgggaactaacattaacagtagttacccttgcaagcaaatggacaactacattaacttgtctaataaccaattcaactttgaattgaggaaattggtccataagttgcttacagctttggatgataaaggctacttctgtttatattcgttaaaaaaaaaaaaaaaagactgattcttatatacgaatgattctcacatattgcatccacttcatcctcatccaatggtgaactcagttaagaacaattcttaacttcaagaacacacctatcctgtcaaaaaaaaaaaaaaaaaaaagaagaaacaacccacctaaaattaccgctggagatgctattaaagccttggtgaatagttgtgcctcatattcaataggaattatctccgttatgattctagactagttggcaagttcttcacgatcgtagaagctcgagaaatctagaaaagttctggacttgatgcccttctactaaaattaaactttagcaaataccctcgagtgtatcccatgtaacgccaaaaatatatttaatcttaatatgtctacatggattgtttttatttaataacagcttatttatttaataattagccaacggtgaagatttgcttctcttggcattggcgccatttgataagaaagtagccgttagacagagagaggaggaaagaggatttggcgcgcgctaatgccaaaccctatataaggaaacaacagaacagagacacacactctgcatctgcatcagtgggtgaagaaagaaagaaagaaagaaagaaaggagaaaagttgaattggaactgttagaagagaacgatgttaggagggaacagcagcagtgagcttcaagatcatcatagggaggcactcgtctcgtcggagggtccttctctatccacgtctccatcggatcaagggaataacactctcactccgtttcttcacagcacctccattccggtgttgccagccgaggttgaatttccaagctctcagatcaatcatcactcgcggcctcctccacggaagtcccgtgagcacaggagatggactgaagaagaacacctgtactgtttgtctctctctcagtgttttctttcttaatattgctgtttcattgtttttctctcatgattcaaatctttataccaatatgtaggttgtttctccacggacttgagttatatgaaaagggagattggaaaaacatttcaagaaaggttgtcaagacaagaactcctactcaggtggctagccatgcccaaaagtattttcttcgtcaggcctccgataatagaggtcaaagaagaagtattaatgacattaccttacaagaccccgtccctcaccgcattgaccaccagaatttggttgcatcattcagtccctcacaacatcaatcagcgacattaggttccacgcagtgcaacactgaatcaaaattagcatgattgtttatattgatatctgttcatttacattgtttaaaattgttgaatacatagttagtcatgtttgaaattgttcaagaaaagttaggattaataataattgtggaaatttctgtagccgcagagttgatgtttcatctttgtgtttgaacgaaaatatatagcacaattttgattagtcttccttaaattgcttcctgttgtatgtgtttcatattctttgactttcataaagcgtgtataatatggtgatgatgtataatatggcattgtagacccattgtttgtcaaaagtatgacatccctgaacatctggtgatgatgttgatgtaagagaggtcgatttctcaatccatgatgagcctttgctttccatgcaatctcccgaaacacaatctgataacaccagccaaagtttggaagacatggcagtccattgtctgagatatttttattttagttttatttatttggtgtatgttgtcttcatgtgtatcagatttacctgatattgagtaagctttaatttctattttgtagagagaaagtgaaagagggagagagatagagatagaggggtatatgagtaaactttaattgggtactttataatgtataactactcctacctaatatttatattactaggttaagtacatacaagcacataggtcaagaccgtatacagactaaaactttactcttagcactcccactcaaacgggagtataaatgtttttcatgcccaactcgtaacaaattaaatttctatgcacttcattaaaagcttttgcaaatacatatgctagttggtcatctgtcttgacataattaagaggtagatacaagatttatgttggaccttatctcagatgaagggacaatctaccttaatatgctttgttcttttgtgaaagactagatttgatgtgatgatatgaatgacaacttggttgtgatcaccccgcagtttcataggacaagtattagcaagttccatctcctacaaattggtctcacgcatatcaactcatcagtcataaccactagtactgttagtattttaggaataagataattggattgattgtttaatggctgttgacgttggctttagagaggttagtaataattgacttagtcaagggaattgtatagaagtgtaatagtgaataattggccgtgtagctctcaacaatagtggaggagcttgtgttgatctctcaaaaaagcacactacaacagagtgcagattccatatttacaggcaacacttcactgactacatatgtgggtggattattaaataatattatacattattctagcattttcctaacttaagaactatcgagacatttctattatctatgtgactactatagctttatagaaaaatctagaattatcaagacacttctatagctttctttatatatacacacacatatatatcaattataaccattgacttcaaatatgcatgcctaagtaatgatggccctaaacacagtcaaagtgggcgaccacccaggacctcatatatagagaggcactcttcttcttaatttttaggtttaaattcctgcaatttagcattttttttcatttttgtctttgaaaaaaataatatattccagttcttgcaaaatgtgtgttttttcttcctcaaagtgttttagataacactttttttactatttaaaatatattttttactattcaaagtgatatataaagtattttaagaacgaaaattaaaaataaaattgcaagaactaaaatgaaacaaaaattgtacgagtgaaagcaaaaaaaaatattaaattatagggatgaaaaaaatatttaaacctaatatttgttattaactataccctttatacccataacattgttacataaccattattccaaaatgtattttctagaataatattttgttttaaacatctaagaaagtactttccgaaatgttaagtattaatttgtattttgaaaagtatttttcgtactgttatgagtttcataaaatactttacaaaatgttaaaaaaaaatggaaaaattcaagcagaacagtaggagtctaggaccattaaaaaccctatacaaaggaaaaattatacaatattgaagcaattcaagtgaaaaaacatataattggtaagggtccttcaatttagacaactctaaaagatgtttgctgcaacaacttagatatacgttgatgcatatataaaatgatagacattaatagtgttgtgagagagaaaaaataaagcaagaaagaaaagtagttgagagcataaacatactacattagattagagtataaaaatcctaatgctaaagcaagaggtcgagcaagagatcaaatggggatgaagaaagtaaagagaagaggaagcgaaatgaaaaagatggaaatgtgtgcaaaacagtgcacatgaatggccatgcaagattaattctcttgcaccgaccataaaataaaacaaataaaaaattagaaaacttacctttgtttaatgttccgagttacatggttataccggatttgaaaagtgatatatctgtattgcgctgcgttaatctatctgcaaatgtctatgttctttaaatggtaaaagcaggtaacacttacattagagtgctgaattggagtaaacactaaacaacgaaattgctactttcacaactcagtacagtttttgaagttctcaattcaaagctgccaaacccattttagagagagagagagaaaaaatgcagatgcaagacttacaaaatattttacatagcacttattaaagttaattttgcatgatgtacatatattcaagtcccttatatttacactgttgaatctggctacatagataatccgaattacatgaatgtctaatataagttcaagtttgtaataataaatacatacacgatatcgaattgtttgaatttctttttacattaaatggatacaaacaataattcatgtggcatctcctaagcaatccaaagctagaagaccaaaaactctggtcacacgcaatcagcccttcgattggaggaaaaaattgaagactgctagcaattctggggtctggagtactttggaggaagagatggacacttttcattcatatgagggtatggttgcatggtgttgtatccaggtaattccattctatacttgcctttaatttgacaataaggaagcttcaccgtgtctccatcattgcaccattttggcaagcgactagaattgttctcaaaaaaattgagaatgtaagcatcttttatctgcacttattgcacaaaaataagtctatatgcgccaggtcaatatactactgtaaagtgtttttgacttctagaaacacaaacaatatatgtagtgaactgatatcaatcctgctcaacaacctgatttcactttgtaaaggattttgttagaaatctatacaaccatgataagaaattatatatgctcaatcatttgtataaattgtgtaggatgaaattcaaaagttactataatattgcaagcaattcaaaagaccaaacttcccagcaaactcaccgtaaactctgtcacttgaacggaactagaaattggatcaaatagcccagcctccttgtacatctcaagtatataagcaatgcacgaagtcgacttcccatcactgtaggtccaataatcttgttcaggaatcgtcagtagttcatcaaaagatgatccacgcttttcaacttctactaaaacttctggaaggtcaagtccctgtagaaacacaaaagggccacatggttcactttttttcactaatgtggaattctatattgctgattgcttactaatctatgcaatatatcacatcacaagcatcttatgacttatgctagacaattgaagacattgattcaatttactagcataagcaaaaatgtttagtatcacatatgtatgtgtgtttgtgtgtgtagacatccattcaccaacttgtgttgtctcacattgatgacattgttatacatttgtaacatgtgaattattcgcgtagctgtgcgtattatttaaattcctagtttccacatttaggagatttcagcattaattataatacattttctgatcaagaaataaaattattatttctcctttttcaagtgtgtgtgtgtgtgtattggagcaagaaacaagattgcagcatactttagttccaagtcgtttgttcaaggcttcattccacatatttgctgcatattcaggttgaagttgactccaaattgtcataacgcaagcaacctgcagagaaacaaaagtaaatgctcattcataaaacattaagctatgtagcatgtggctaaaccaaaaaaagacagaaagggcagaagatagagaaaacaaacaatcaataattgataccacattcatcactttttttttttttatgtgaaataacattttcttcaatagcaatggtctttctggatggcagacggataactatacataaaccagcatatggtacggtaattcaagcaaaactttatactattcaagcaacttaagtagaaagctcattgagttcttgcaagatcaaagccatggtttatataattctctgtttgaaatatttcatacaattgctagaaaattgtaggtaaaaaatgctaaagcatggcataatagtgcaaaaactcaagatagttgaatctaatgaaacagatgaattgaaatttaagcagaacaactgattaaattaataccacattagcatccaaggggggtggatagtttccatttaaagtgtctatccaactgaatatcatgttatggtaaccatatggttttcctgccatgctcagtgcatactcccatgcagcagtctcattaaacctggcacgcaaatcagggtgcaatggaagcagagcaatatggggattggaatcatcttcattcagttcaaagtcccaccactcttcccatggtatcacagctattatatcttctccctgcaaacaaaaggtgaggcaggaaataaaatgctagcaacttaactccaaatgccgctgcggagttgacaaaccaatatggactatacttttaccatcattgctcaaacaatcaaacaaccatcatgaattatgtcataaaagaaaatctatatatgttaacttggtaatcaccatgcactaattttttatcacaatttcaaactgaaactgagagcataatcttgctattctgatgacgacatggtaacttaaggaacttaaaacaattcttcataaattatatcaaaacctaaacatcgcataggattcaagaaatgttaattttcttaaggaagaaaatataaatattaatgaaattataaaaaaaattgactatgaaacatggtagtgaaattgagattcaaattgtgaaccggaaggcctattttccagatagcaaattgaactgtatgattaatcataaaacataacatatacaactaaaaaagacataaaagcacaaattcattaaaaaaacataaacataggagcattttaacataaggaaacatattaaaagttaaaacatacacgtgtgttggtgggggggggggggggggggtgtgttagcattttgaagtcaaattgcttacaaagtgacataagcttcaaaacaaaaaaaaaaaaatcaccaattcttaacagccatatggacaaaaaaccagtagctgctcaaactcagcagtatgagtgtatgaccaccctaaataagagtggaccacaaagcttgcatgtagggtagattgggaaaggtaaagaagagtagaagacaagaagaatgagtagaaaacatgaaaaggagacaatgggctgccatgcggttgattagagggaaagaattggccaattccctctctttttcactaatttttcaggtaaagaaaaacaattttagggttcttcaaagttcaaaactgggtcctgcataacccgaaccactttggtgtgcggtcgcttgcaccaaaatcacatgattcatgtgcaatctacaattcctatgtgattcctgctattcatggggtgattcaagcacaaaatgtttcactcaaggaattgagtcaccaactgctcaaatcgaatcgtatgcctttgtatcgtgaaacatatgatactgacaacggtgctatgaaatataataaatcttgcacagaaccaatagatataatgcaacttaaatattttaccttttcattttcatgtcctgactctccaacccaaagcttcccattggagtcccttaggcaaacagcagtgtgaccagcataagctccactaacccacttctctagagtctcaaaagcaccccaccgacctcgaattttcgaaacggcaaggaaatctccagaatgaatgtcatcagcactgacatttgtaacaaaaggctgagggcgcacttcaaaagaagctcccatatgcttctctaaaaatttaatattggagttctccccccatccagtatttgtaaatagaggcaatacctcccaaagtgcttgaagggtccccaacatcccagcttgcaagaggaaaattgataacccatggttttttacctgattgcaaagaggataaggatctccaaaacaaaaatgtgtgtttcaagtttcaaaaaactctacttagtgacagtgtacagaagaaagatggtcacttacatactcatactcagctttcccttcccactctttgaactcaagcgtatgctcccgggccaggaaataataatcccatgttacacgataaggggtggcaaaaatataaagatccatgcacgtccaactgtgagcattgctaacctagatcagcacatagataattatcaatcagtttccgttgaatcccaaatccatacatagagagagagggggggggggggggataaaaagaatacaattatagaactgcatagactaataggaaaatactaaacatacacccaacttttcttccatctcacttctatgatctatcccatttttcttcctatttctcttttcattttccatcacatcatttgccacatctatcagttcctctctatttatttattctctttatctctcttatttccatccatacaccatatttggggagtaagagtttcattactctaatgacatacaaaatactgagcgacattaaatccacttaacttagtctcctctaataatttaatacgctttcaaatgacaacacgtccaaccaaaatccaccaaattacaactcaaccacataacataatctatgcattccaatattaaaaaaacactctttaaatcttaatgacacctactccctaagcaatttttttaaagtaaaaaaaaaaaaaaaaaactacgaaatatttcaagagtatgaccaatttttgttaaccactcagaatgaagatttcatgaaacgaagttgacctagtccttcaccgattagtattaaataaaagttcattacaacaagaatgacttatcataaaatttgatttttttttttttcaacaaaaagaagtgacatagatttccattcccacacttgagaaggaagcgaccttgatgtgaagggttccaccgccatattgagagccgctcttgttgtgaaacaccatccaggctttgttctcgtagaagcaggcgcctttccacttgagactgtcgtccggcgaagaggcggcgccgacgaagacggggaggagatccaccgctctgtggaggcggttgaggatgggccacgacacctgtctgggcagcagaggaagcacgtctcgcgggtgaaacggcgatttcagggcccaaacttgagaacccgttacgcagactgataccaggaggagcagcagaagccacgctatcttcatcttcgccgtggcacgagcacgatcgaagaaaggagaagaaactcttttgaatgttttttgagagtcaactatgcatactttgctcctccctctattttgtttggcatacaaattattggaattttttcgtgtttatcttaattaaaattaaaggtgaatttaactagttgattgaataaaaatgtatgatttgttatcatcttcttataaaataaaataaaaattttaaatttataaaaataaataaataaatataattttttttacaaaatattattactaatagtaaaattttacattgtcatttatcaggggccctaatcaagattaattaactaagggatgttgattttttaactaaaaatctgaatttcaagttctctatgaaaaattatatcaaatacttaaaatgataatttttaattgcctatatataaaagtgtatatctattaaatttaagttgtaatattttttttaaaagaaagagagatatatatgtcattttattcataataagaaaataaatataattgagtatatgatcaaagatataaacactagcatataatttatatgctcttattaactagtgaataacttgattagttagtcttttaaaaatctcaccaaaaaattaaaataaataagatctatatttagacaaaaacgtgtggaaatctgaaaatattaataatctaagagcattgttggatacaaaagatatattttgagctcccataccataaagtcgtatcaatgctttgtaagagagcccatgcttttgctccacgagggttaggaattccaccttgataaaatgaccatgtttatctcaaagataaataacaaccccataatagttatgctccttcaagatgacatcattttcatatacgttgttgcatttgagacgaccagttgttggtgcttcccatgatagattaattcaaattaaggaggctgaggttgcatgttgatgtcctttgtgattcttcacgcatgcttcaattccattcagaaaagtgttgcaatgccataaaaactgataatatttatttgtggctgaagctcaatattattccatattttctcattttgcctttttcaaatgcaccataaaataacaagaaaattgcttttaacatctagagatgccaggagattgaatattaactcataaattccttcaatgctctcactttgtttttaataactcgtcataatccaactgactcccatactttctcaactttaattgaggacacctgaaaagaaaatggatcagtcattcaatattataagttataatattaatatttaattaaaatatattaataatataaaagttcttatactaccgtttatatataaattaacgtacgtgtataataactttattgaatattataattactgtaaaactcatatttataatatttttaattaattaataatatagaaattttctgttcaatttttgtacagtgtgagtataaaaaggtttacagtgttaattgattagaaatgtaataagtatattttaaagtaattattgttaaaatcaacaaatttatagtacatgcattaaaaaaaattaatattgtataataacttatgattgattaattatataaaaattctttaagcaaatagtgtatacttactcaaatttgtatactattaaaataaaaattaaaattatgtaaacatacgaagatattaaaattttgaggttaaatatcaagtcttgcagttgcagacgtatgaaaaaaataagttatattaaaaataaaaaaagacagatattttgttggttcggatgagatgagaagactgtgataatcataggtgaggtggtgattggtgaattgaaaggtgtccatgtgttcaaataatgtaatactacataactacaacccaaaagatcatgttactacaaaaaagatggttgaaataatataatgtgtgatgatacttatccaacacgtgtttaaactataaaaatgatgctaattacacagcagagttgtttaattaaaaaaaaggtcgatgtaatcaatggctgtcgtaattaaccaattgtttgatctctcaacaggcatcatatataccgtatataaatgtcgcattaccacatggttagctttcgatctcatatgtttgtttttctatgaaaataatggtgaaatatattttattcgagttagtaatatctggccaaacatgtgtgtttctttcttactagtcgtgttggaatttttaaaaggggttcatacttattttgtttcatttatattttcaaatagattaaatattcgattgacacgataaagataaaaaatatactttaaattaagatagagactaagaattatgaaactcatataggacctacattattatttttaatatctcaaccaaatataacataaatgccaaaattaagtcatcgatcctagtaaatttataatgtttgtaagataaaatagtagcttaatctcaatatattcataacataattatttttttatcagtgtgcaaataataaaattattatttttatacattttttatatttaaactacaactagatagatttccataaattacaaataatgctcaacacaactacttgtttaacataattttttttagctaaatactcatttttgtctcaatatgtaaaacataaataaattcattcttaaaagatacaaatttaaattttatcctccaaagtgaaaaaaaatgtaacacatgtgtttttatttgaatctcatatttgggataaggtattctcagattagaaatttaaatcaacaaataaataaattatgtttattattatgtttgttttaacttatatttgttttcctttttttaaagtatttattgtattattatgcttgcaacaataaaaaaaaaagagaaaagatgaaaattaaattatattttatccttaaatgaaacaaaatttagtatataataaattagtccaataaaaatttaatgacattttggttcaataaaaatttactaacattttagtcaaatctatatattgacaatcatttttatgacattttcgttcttatatgacacaaactttttcgccaataatgaatgaaagttaacagattgatgaatttgttgtacttctttcattttcaaaaaataaaatttgaaattttattttttggagataaatttgtaagtactctgtacatataaaaaatgattatttatcctaatttttttaactataaatagaatattagggatttattggaagcttcaggtttggtatattccctttataccattaatatatcttataataatgttatttttatctatctgtttatcgaattctgctcccactgttggctaatcgtgcaaggaacatatttacttagcaacaatgtcgtgacaagtttggcaagtagacggaaaatctaaaaagtttggaaaaccacgccatccaataaatttcaaacaaaacaaatcgtgggcgtcaaagttgcaattgttttggtgaattggtgaccgtagcagattgctctgtgacgttgcacaaaaacttcaatcaaacaaagaatacagtactctgcacaatatattatagaagtaataaaatatatactaataatttctaaaatcagagtggcgcagcggaagcgtggtgggcccataacccacaggtccctggatcgaaaccaggctctgatataaaagagaaaagcttcctatactttttttaatttgcagatatactcttatttatttcaaatcaaacaaatacattcttcctattaatttcaaacgaataacatttattcacaatacatatcttatcaattaacttcatccccttttcttttacctttttcatatttcataattaaaatataagttttctttacatttcaaaaaaattgcatattcttttaccaattaaattttaataatctttttttgtgtatgcatcgccactactttgcacatccactaattaattacattttccaaatgcaaattattgctcttattatgacatttgttaaggaaaaaaaaagaaaagaaatgtacttattatatttagaacaatttttgtttaattcttatttttatgaaataaaaaatattcagagtgggtctaataagacatttcaatttgtctataatttattttaatatcttataaacttatttatccaaaattaaaacgttttgcataaaaacaaggacttgaaaactttatgtaacgaaaaagtgaccgaagatctaaatgtattaattaaaaaaactaaattcaagtaaaaaattgtttgtaaaaaaatacatattaattataataaagaaataaaatgctgttaagcaaaaataaaaatgatgtcatactaaaaataacatttctctttaaatttcaatgtaaaagtgaattgtgcaatctttgtttgttttttaaaattttgaagagaccaatattccaacctttagcgtatggccttcgagccttgtttatgttagaaaagccacctacacaagcaattagtatatttggataaacaatttaatttattaattgcttattattttttattatgtaagagattttgtctaaattttaccataaaacttattttcataaacttcgtcaagaaagtttatttttttattataaaaaagtagttaaaatatttcttttctttactatcccaaattcatttttttctagcatccaattgaattggaatatgaaatatcataataatgataaaaacatgatgtattttttttttatattccttaaaatgaaacaaaatcttgaaatacaggttgaatttttcaattcatttcaaaaattaaattctatctatttgttttgttgtaataagcatttgtggattgaatgcaaaaattattatgagttaaattataaaaaaacaaattaaaaatgaatattcgtgaacagtataaataccaaaaaaaataatgattattttcttgatatactgagatctatttaataagttgacctctttaacatatatttttaaatacatataaattatggataaaagatcgaattcaaattcttaaccacgtgcaggtacttatgaaacaaaattatataccaactatgtgatactatgttggtgtcaagaaagttattaaaagaatttgcaattgtagtggaagactacattagagtatcaactgctctctctattttgctgggttgctcagctggtagcctcctctatatggtttggcttgtgtcagaatgatggcattttggtttttctttcatttggttaacagatcacatttatttcaatgcttatttttaaattttctctttattatgttcacccctttgttggaaatatttcttttcacttatcttttaaataaggagtttgaaatataatactcagtcctcgccaatatgtatgcacttttactttttaaacatgttcaaatatagtacttggtttttttaataaacaattcacacaagatagtaccctcttcaacgcttccccagtgattctttgatattcagtgcgccctaaatctttcaaaaagccatgttcaggttcgacaccaagctgttttctagagagaaaaaaattgcacattcaacatatctggttcatctatccatttttccaaagctagcttgctttctggtttccttgtcaattgtcaattactgcatggaactctcttaccatcacagggtactatacatatgactcggcaacagaaacataatataattagttgtctctacattagtcaccctatccattataacttctgaggcagcatcctttggtatatatcacatatctgaaattaatattgctgcatacttggaattatccaagctaaatccgcacaccttacctaactttttttgtcaccaacacatgcaatcaacacatttggtttcttatgcatttttccaaagcttgctttctggtttacttgtcaatcactgcatgaaactctcttaccatcacagggtatggatatggcccagcaacagaatccataatataatgagttgtctctaaattagtcatcctatcccttttaacttctcagatagcatcctttagtgcatgcagtagttccatgaaggtcttaatacattcaacacatagcaaactaggtttggactttgtacgcactgtcacatcctaaataagaaaacacatttagaagaaagaccggattagaagaactaacatttcaaatggtcactattgcaagtttgcaacagcagcgtattcgccaaagagtcccacatcagttagtcaagaaagcagcagaacatgtaacagaaataaaagcaacaacaatatactaaccaaagcatgcctttctcggccttttgacagtgtagtatctgttcttatcggtttaagtattcaagtgtcgcctatttcttgcaatacagtataggcctggcacaccctaccaaattgtttaatttatggttatattgtttgtgctatctgcttgtacgatcgaaccattagaaatgattcactataaaacctattggctattagagaaaaagcttggttcttgtaatacgttttgttaaaattgtgttattgaataatatttgattggattagtattatgttgtgtacattttattttattgttttatacttaaataaatggatatatattatccctaggcacatgcattgaattatatgatacaaaggagttagtgttttcttggcagaaagtttattgaactttggtgttttatgcagattcactgaagaaattaggcacatttaatagttaaattagtactttttttttttctctttcccttttacttactacttaggtatgtagctatctaaatcacttgatattggcctgcatagccttgtgtgatacagatgctactgaaaatcagtttaccataacaaaagtagtcatctgtaatctacaatttagattttattcggtaaaattaatatacaagtgagcattatatccaatgtaagataaaaagattagagtttatcagaaggaaaatccaagtgccaatcttattaaaacctagctaataatgtcttaacctcattgtaaaacaattaaatctaagagaagtcaagtccctagctgaatgccctggcagagatttagaaggtatacatgactaattggagccatttcttctaattccatgtgagtatagtcgtctcacagtcatagcaaattgaaatccttttagttggggttataattggattccttgtgtcattattagatgttacttttgaaggcttataataactttaaatttacttagcattgcacttttcagaagtattgtcgttccagttcatattcctaaaatcattttatgttttagtcttatatatatgtccacagtccaccaattgtaccacatttaggctccacatagtgccatattttaggacagaagttgatgttcatatatagatgaaggttattaagtcgaggcctatctttaagacacattttccctttttgcttggtttttgtttaccactatatggtccccttttgcacttattgttttttttttttaagttccctttgaccttattgctaacggataccattgaatttaattgtaaataaatacattattcaatacagtttgaggcaggtgaagagttcctaaaaaaagttgccatgttaatgaaagacctgaaaatttatcacgatggctttgtgcaatttaattcaattttttccccattttaatgtcctgatcgtgtagcatttacagtttttgtttcagtaggtgatctagatacctagaaactttaattagggcaagctttcactaatctaagaacagattgctgaacctatcttctgattattgtcgattttagatcctttaattggagctagctatgttttattgcttttgatttcttcagttcaaatcaaagatgaagctttttggttacaataatggggaagaaatcattgcaacccttgttggtaaaaagagtcgtatgacggaacgcaaaatcagcaaatattatctttaatttaatttattttttgaatgaaattttgaattgatacttgtaaaagacgaaataaaataaaccaatgaggtaaaatgaattaattttttttatcaaaattaaaattaacttgtatacttcaatttctttttaaaaaatcttatttattttctttttaaaatacttataaacttagaaattcagcattttggtcttaaaaaacttgtaacaagatattacaattgaaaagttcttattagttaagatgtttctaataaataattgtgaatgtatttatttcattatctaaattgcatttcttcactttagagaaatcttattttagagaaattaaatcctttttttcttagttcccatattatagcagccagtgacaaataaattgacataaaaattaaaaaagttaatcctactattattctaacaatgatacatatggcagaaaacatccccccccagaaatacacgatttcatctttatttttctccttatccatccgagtaatataatatttcaatcttattgttctttatcctttttctcttctctcattttttttatatgtccaaatccgaacagagtataaatgtaaatacctcatctaacaggaattagaatcacaattgctgtattttttggaatctcagtccccccgctccctgccagttttcatgaaaaattaacaatatattagtccaaaaatgacgtgctcaacaaaaacataactttaaatttcggcatatcacatgtttaatagtatatcatattttttttccaaataatttttgaatttggactgcaagtttcaaaaaagaatatattctctggaatctgtgatttttgttataacatcaactttgactgactattaattttccttgcaaaattggctttttattagtgttccttgtctttggaacgtgtacagagtgagtcttttctttcctttttttttttttaaaaaaataaacacttaattttctccttcaaaaattagagtattgctatattattttccccaaaaatttggtaagttaaatatatattaaaaaataaaaataactaattttatgtcaccactttatacagaaaattcagtgacattttagattcataatatttgaaggattaacataatagcatactaatattgtaagattaaaatgatgattctaactctattgattgaataaaatatataagttgttgttataaattctaagtatttctcttctatttgtatggataaaaatattacaaatattttattttattgaacaagaatacaagaaaatattcatttaatcaaagtgaaaaaaaatccttatatttgtataagttaggaatacagatatgtagatgggtaaaattataatttaaaatgtaatatactacatataatattccacctaagtactattaaagagattggtatattaatgaacatttaagtaaaaaccaattttttttaaaaaattgatgtctcatcatatcatttaaatgagtttattgtcattcaaaaagtttaaagaagtattgtatagatcatacacaaaattaggtacatgcttaatcaaacagaatataactgaggtagataggaaggatacaaagtagatataagctgtccatataaaatagttgtcataatttattcttgactagtttcattaaggagtgatcctctccattttggttggcataataaagtgcaacctaagagagaacacttaatgaaatcctatattgaggaactttagataatgatattaaagatgagtgactccctaacggtcatttttggattagcatatttgacattcatttcttttcctaactatggcctttgaataacaatgaaggaaaagtaaccatgccatatgggaaagtttgtgtgaagctagaactcaggatcaatttggtttctgcagggccaatgtttcaatgaaaaacttcctaaattgatttgaagccacttctggagggtctaagactgcatgcattggatattggctaacatttgcatgctaagagacagatttgaaaaacagatgcatgaatttgcaattctgtaaatgtgggtttggttagatcaattatttaggagtggaagatgagtttcttttcatgttgcacatcacaagagaagatcgacaataactcattgaaaaggagcagtaagaactaccatcacgcaaaagctctgccatgtttagccaacatgtgttttaaatctggtatttttcctagctccaatgctaattttctcattgtatcaattttcggccacattttttcaatttaatgtctcatatctacagtttaatgttgtttccacgacaaattattttcctctagcacaatcttatttatctcaacatgaaatcctaaaattgaaatccatgaaaggtttataccatcacaataggcttcatcaactttttgattattatgaagcctcaacgatgtgaaatgcagaagtacatgcatatcttgtgcatctctttaggctcccttcctagtttaatgatgttcttagcttgttgataacatgttttgaaacaatttgtgccaccaagttcttacagattatgtaccaaggtcttatcatttgacaacaggattcaaactcacatccttgtgagctatgagtttatccttaccaattagggtatcataaacctaaggatctcttactctcaacctcaatagttgtgtctcaattgttaactctggagttttgactttttacaatatattgctaagctaaaggtgcaaagtggtcttatagtgccctatatagtggatttcagctttctcagacatttttttctcaatgatgaatacgatgcttaaaacttgaacaaatttatcttgtagataccagcaaacggaagtacatagaagaagaaatagcaaaaattgggaaagggaatattacctctcagactttttcttatcacgagttatgtgttgcaactcggaactttcaccctgacaatatgattggtgaaggaggctttggaagggtgtacaaaggacgcctcaaaagcctaaatcaggtataacttcaactcgcatctatgtgaatattatgctaatatcatgctaagaaaaaacttctaaatgctgtgttcctttcatgcaggttgttgctgtgaagaaacttaataggaatggattccaaggaaacagggaatttcttgtagaggttttgattttgagtctcttgcaccaccctaaccttgtcaatttggtagggtattgcgcagatggtgatcaaaggattttggtatacgagtacatggtgaatggctctttagaagatcaccttcttggtaagtaaatgcttcttatgtcttctaatgcatacatcacggataaaaatgagaggaacatccaatttgagtatcaaacttcaataaatgcaataaactaagtgtagtctgtagtggcagtgtgaccagatgagcacattggatcatcatggttattacttattagttacaacataaaacaatttgcatattgatggttttaagtagattatgttttatctttccatttgtgtgagaaaccaaatatatctgcaagactggcaccgtggaagttccccttttcaaaacattaccctagtatttttatttttttttgtgataagcatgctaaatgttatctgaccaacaagaaaagaaaaatgattgtcagaactacctccgaacagaaagcctttggattggcgtactagaatgaacattgcagcaggtgcagctaaaggacttgaatatttacatgaagtagcaaatccgcctgtgatataccgtgatttcaaagcatcaaacatactattagatgaaaacttcaacccaaagctctctgattttggacttgcaaagcttggtccaactggtgataaaactcatgtatccaccagggtgatgggaacttatggctactgtgcacctgagtatgcctcaacaggtcaattgactacaaaatcagatatatatagctttggagtagtgtttctagagatgatcacaggaagaagagcaattgatcagtcaagaccatctgaagagcaaaacttggtcacttgggtatgtcatgaagcttttattatgtgcctagaatcatatttctctggcctaaaatttcaggatttataatctaatcaagggcaaaatgtatcacaagtcccttcatttttggtcaaaattggttttagtccccatattttaaaaataataattttgttcatcgtattttttgtaattggtgaatttcgtctctgaccctagtatcatatgttacattaagagagatgactataaaaaataaaatcatggtttttaaaatatagataccaagattaactttgactgaaaattgagggacctaaaacactttttaccctctaatcaatatgaaaactagtccaaaaatttaagcttagaccattaatatgcacaaatgttcagcaattgacattcataatgtttcttgttttcaggcacaaccactattcaaagaccgaaggaaattttcatcaatggctgatccattgctgaaagggaactacccaacaaagggtctacaccaagcaatagcagttgcagcaatgtgtattcaggaggaagcagatacccgacctttgattagtgacgtagttacagctcttgatgttttagcaaagaggcatatacaagtgggaagacaacaacgttcaaaagagacttttttcgagcatggggaatgtagttgacaaaacgaacctgaaaacagtagaggattacagaaaaggacaatgaatgaaaaagcagctgctaatgaagtttgagaatcattctataaaatttcttaatgatgccacttggtatccttatgaaaatcgatcaaaacggttacatatttttgcatgttcagatttattgagtagtagtattagataatagatattgataatagaatgacaagattgttaccagattcataattgcctactcttcgagattctctaatcaatactgttacaacgtttcctttttgtttcagctttcataatggaaaatacccactcgacaaaacatttgactccatatatcttgtgttgttgatcataaaaccaaagcagtgaggtcaatgcaattcctttcctccttaaactggcttatctagagtaaaatggtttcatgaagagtgttctggtctttcagatgataatgaaaaatggtttccagttcaaagtggaaacctccttttggtttgacagaaagaacattatcatccatcattagtggcagaaataaacttgcacttaacataaactttagtctatcttcacaaaataaagatatatatttgctaataaggaagcaattcatcttgtacacatggaaaagtcgctgaagaaatgtcttcaaattaaccataataaattacattgctctctttggtcccactttcaaaaaaaagaaaatctacgttctcatcctttaaattgcctctctcaattgcacataaacacttgtaatgtctgaaaattcacccatttcaggatacagtgtaatcaagggttgaatgaagatggcctagggctctatgatgctctcataatagattacttagataatttaatattaaaaagaaaatttcagtaaattttatattatttagtttgttttatttatttccatcaaataatatataagataaaaaaattatctagtaacttgacttgtgttgttcttatgttgtatccattaaaagcaccctaagtgaaaaataattgttacaataaagtaataaaatgtacaattaaacaaaaaagtattaaatgagttttataagttttcctacattcgtatattttatctatttttatgtcaaaattcttaacattgagacaatgaaaaatattttgaaaatttagcaatttattttaacttgtcttttaatgaaataatttattgaaaaacataatcaattctttcaattaaattttattaaaaattgcaaaaataaacattgcataaacaaaacaacattgaaaataaataatatagattacacaagtaggttacataattcaatatttttctcaaattatgttatatagtatcttataatctttatattatttcttcagatgtatttataaatttataaaaaggacctccaatttttgttttaacttcaagccttttttcttaacagcacttcaagactttaaccatccaatttttatttgcacgcttcattatcgtattttttaaaaaaattttgtacattttaccaattcagtgaataaagtgttgatctgtcccaaaaaaattataatttttttattacttttttgtggaaaatgacgtcattttgttaaaaatataatgataaaatgtggaaaaaaacatgaatagtaaaatacgtgaaaattgaagataagatgataaaatgattaaaaaaaataggcgataaaatttacaaaataataacagttaggtttgtaaattatgcaattaagcattaaaaataaaagaaggttatttgataacaaaatgacattgttccatttttttcactatttttagggatttattagtatgtgattacatatttattataattttatgtttgtaatgaataaaaaaaataaaaattaaattatattttaggtaaaatagtgataaattcatctctaattatttaaagtgttgacaatttcgttttttagtgtgtaaagcgcaacaaattcgtccatgaatatatcatctagactctttcattaacgataatgaatgaaattaatggattgatgcatttttttaactttcaagaaatttttttaaaattttgatatattagaaatgaatttatcaatatcatataaatttcaaaataaaaatgagtatttattcataattttatgttaaaagcacaccaaacagcacctaagactcctatttatgcctccgccgaccgagagggcatcctagccttccaatcataagattacgtggcaattaaatattataacaccttatttttatttggggttttattttatacgtattttatattaatggccaaggtttttcaaatattttgctccttttttatatatatatatatatatatatatatatatatgtatgtatgtatgtatatttttatatattatatattcaagtagctggctcctaatctgtttaactgtggagggagcaggagcactcggaggtgatttctgcctcaatggaggtctctgctttaaggccacactgccctttatgccgccgctgcttctcaagtcccttctctcttccttcccttttaccttctcagcctctgcagcggtttaccctttttcctttatctttttttcacttcaaatttcatgtcttttgttgcttctgacctcgcccatctctttaatatccttaaattttgcatcttttccaactgggtattctgcttttagcttaagaaattaacgtttttatgttacacagtaaaatatgctgattgttgtttttttgtctttacttcaatgggtcagtgtgccttgttgttcttcactggtttgaaaggttgtgactggtattaacattaagtcaagtgtgacttttcaaattttacttgtattgtaactgctgtgacaatttgttgatgataaaacctgaaataggttaatattaaggattctatccggggattaacttttgttagtaaatgtgggaatagagtgatgaagagatatattttctctttgtaccacacatgcctacagatgaagctttttcttagcttgtggatggctacatttcattgattggaacctttatttttgttgcatgatgtgaattgcagaagaaaaatgcagtcattccaaatttccctccgaaatagcgctgtgcttagaaattatgtactatgtagagcagatttctcatgctgtctaaaggggatatctgcggggttaaataaatacaatggcgtgaggtgtaagcgtaattttctgtgcaagagtccagtttgcatttcatctatgaaaacttcaaatgcatcaactagcacgttggaggaaatgactgaggaggaagagctgaactctttgcattcatgtgaagcccaagttaggacgatgggcatggcttcttgcaacaatgaattttccgaaaccacttcaggaaaaaaattgtctggtggtgattatagaggctggactatagcaaaagataagttaactgaaaataaaaaggaaatgaacggctcaaataaatttgagagtgaaaatggcagttttagtgcatctaatggagttgcttccattgatcagaaccaggctgttccaaagaacggggatagcaatattgtactgcaggattctggtgcacatgtcccatcttctgttaactattctgtattaaacaattcaaaggtgttaatggattctgaaagggtgattcaccagtataacggatcttcattggggattggtaaagaaaaagtccctgtagtcaatggtgatcatggtttggatggaactgcaaaggattcaactaatgtaacacttactaaccaggcatgtggtactgaccaatcaaagctcctggataggctttgtagtatatatgatgatattctggttgttgataatattcctcttgcagaggaagttgctaagatgcttacaacaaagttccagcatcttatttatgcatgtgataccgaggtataattctttttactgtatttacttgtattatggttactccatatcacaagattatctcctttgttgcttctgtgcacgtgtgtttgtttgtgtactttggacatgaattcaactaatttttatttgtgtaacacattatctgctgattttattgtcttcaaaggtagccaagatagatgtcaaacaagaaactcctgtagatcatggggagataacatgcttcagcatttattgtggtccagaagctgattttggaggtggaaagtcctgtatctgggtagatgttcttgatggtggaggcaaagagattttagaaaaatttgctgaattttttagcgattcttccatcaagaaggtgaacttttcttcttctatcccttctatgttcttaatcctattactctcctcaacatgcaacacttctcaaatattagttctatgcttgctactttatgaaatatgccttcctagttaagataaatgacaatcagctacaatctgttctgaaattaacctcaggtaatctaaaagtttagtgtcatattatacagagagctttatcgatttttactgtgtgttctgtggtatattcaatttttcaataatatgctaagaataggttgcaacttgcattcctaatgttaagttaatgtgtacctgatttaggatagttggtgcatggttttattgtatagaacagagaagttttcatcttatgatagaagtgaactagcatgatttgttattctattttattttatttgtgtagttgttagatattcttatcttgtagtaatagaaaattaaatctatcttttataaaatcatattggcattaaattcctgggtttgtctatgctcgtgaccagagattacaaaccatatttgaaataaccgagtcactggtgcattctgtaggtctggcataattatagctttgactgtcatgttatagagaattatggattcaaagtttcgggatttcatgctgatacaatgcacatggcacgattatgggattcttcaagacatttggatgggggttattctcttgaaggacttacaggtgacagaagggtcatgtctagggctcagctgaaccatgaaaaggacttgattggtaaggtgtcaatgaaaactatatttagtaagaaaaaattgaaaaaggatggatctgagggtaaaacaagtatcattgctcctgttgaagagctacagagagatgagcgtataccttggatatgttattctgccttagatgctagcagcactttgaagctgtatgagagcctaaagagccatctttcagacatgccctggaaatttgatggtgtgccagtttatgggaaaaccatgtatgatttctacaatgaatattggcgtccatttggtgagcttctagtcatgatggaatctgagggaatgctagttgaccgggcttatcttgaatgcatagaaaaggtggccaaagcagagcaagaggtagctgttaatagattccgcaaatgggccactaggtattgtcctgatgcccagtatatgaatgtgggaagtgattcgcagttgcgccagcttctttttggtggcattgtgaacaggtgcacatttttaaaatcttacgtgtagcatttatttcaatcttaaattaatgatttgctagtcaaagcctgaaatatttatgatattcataagtttaatgtattcactattcatgaatgatggtactactactggtacctaccttgatatttatgaacttttctgtttacaacaaagtagctgaaggatatagatggaagtaaaattttcatttcacttgtcacatgcttcattacagaaaggactccaatcagacgcttccaactgaacggatattcaaaattcccaatgttgataatgtgattgaagaaggtaagaaggctccaaaaaaatttcgtgatataaagttgacgagcctaggttataacctggagactgagatgtacacagcaactggttggccgtcagttagtggtgatgctttaaaggctctggctggaagtatttccgctgattatgacttttttgatgaggattgtaacttggatcttgatgatgaagatgaaaatccttctcaaagtcaagttgcaccggtaaaaattgataaatctgcatatggcacagcctatgcagcttttccaacagagaaagaagggagagaagcttgccatgcaattgctgctttatgtcaagtctgttcaatcaactctttgatctccaacttcatccttcccctgcaggtatttttttattgtttggtttgcaatatgaactttcttgagcttgcttggaatttcttttattttgaaactagtatacaaacttccatactgttcatattgtccgtaataaattgatgatatttttctattttttccctagaaaggatatttttagacaattataattattatataaacatcagtcaatgagatgcttgacaactcacctgtgcaccaaactcacaagtaccacagtaccttgagcttttaaaatactcattggagatggtcaatactaagttctcccactgcttagctatggctagggaaatcatttccttatctgagtttaagctaattttttgaatgcttattgtgccaccacttacattttagaacttttagtaaatatttgtattcttacactgaagctctttatatgtgctctataatagctgcagtttctctttgtcagggacataatatatcaggaaacgatcttcgtgttcattgttccttaaatatcaacacagagacaggacgcttgtcagcaagaaggccaaatctgcaggttattctaattagattaatcagaattctctaatggttttgattaggaattttcattttaatagtagttgttgtgaacttcaaatttttttaagtgctatacatttgagatctgaccattaaccttcatctgtgtgcttgtatgttcactaattggtgtcatacagtttccttgatgctaaactcttagtagatggctttatcattttgtcttttaacctaaaatgtagtttctccttttagtagggtttcttcctattagacatataagtccattttggacctccactctatctttttgctgctgtttttcttaattaaattttggcagtaaggttgaacaaaaaataaaattcagcagaaggtgaaataggtctgtggattatatgtgtttcaaacctgaattattcttgtgtgaggtagcgtgttaaaaatataaaaccctttttaggccgtcatctatcaaatatctcgaggtcaagagtcagttcttgacatctctgctcaaattacattcttttgtattcatttattacttcagttaaaaatatcttattaaaattagtgtttttggactaatcacagccttgctaattgcaatacacatttatgtaatcatttgatgtctacttggtcttgatgccttttctgttactttattacaatgatttggatcctaaatttggactgcacaatgcatctcattcattttcaatttgtattttgacattgacatgtgggtattacatctactagattaatcagaatttcaaaacaatatagaacctaacacatacacttcatgaattagaatcaacctgctctggaaaaggaccgatacaaaatccgtcaagcattcattgctgcacccaggaattctcttatagttgctgattatggacaggttaacagtctatattgtctatctaactgaactattttcaagaaatttcattctgttaactgccttgtttattgttacagctggaacttaggattctggcacaccttgcagactgtaagagcatgttggaagcttttgaagctggtggagatttccattcaaggactgcaatgaatatgtacccacatattcgtaaagcagttgagaaaaaggaagtgcttcttgagtggcatcctcagcctggtgaagataaacccccagttcctcttttgaaggtaactgtccgctgatagaagtaccatttcattgagatgtggaagtagtggctttgtctttagtttggtatttcttgtagctgatgacgtcaaatatagtgaccaccagagtgctggcagatgcatgagggaggactaatccttattctgattggaccgagatccatcaacggcaaatagaataaatataatttattaaaaatcagaacaaatacaaataacttgtgaactttccaatagaaataaaggacagctactgatcattagaacactgtttagggggaaaacatagttgcagtggtagtagaagaattcactgagttttttgatatataatgtgtttaatgatgtttatgtatattaatagaagtaaatcagaatacaccaggcattaataagcttttttagtagtttaacgttatttgatgcccttccctcaagatataaaaaagttgttttagcattttactgttataacttataaccatctaattcatgattgatcatgttttgatttttgttttccttccatgtcaggatgcctttacttctgaaagaagaaaagctaaaatgcttaacttctcaattgcatatgggaagactcctgtggggctttccaaggattggaaggtaccctgaacttttacttattatgagggatttacaaaggtgaaaagtgcccttgatttattatttgattgttcactctcaggtttctgtgaaagaagctaagaaaacagttgacctttggtacaatgatagaaaagaggttttgcaatggcaagaggagcgtaaaaaggaagctcgcgtgttacattgtgtttacacattgctagggagagctcgacggttccctttgatggcccaagctaacacctatcagaaaggtcacattgagcgagctgctattaatactccagtgcaggtccttagctctttctaataaacaaatcaatactgtgtctccctcactcatctatctaactgtctttgcacactctagtaaataaaaaatgtactgaattatttatcttgtgattcttgtctagtttggaacttttcccttttaagaacaatgaatgatgagatcacattttgagagcccacttgtaaaatatcatattccatagtttatattgaaatgatagtccagatagagctgtgaataagaatagagtttgattgtattaacattacaatagtgtcatcttgtattagtctagttagtactgttccctatcaggaatctccttttttgaaatccattattgggtgaaattatatttcctttacatatatttgatagagtgctaattctactctaccactactcctaagaaaacaccattaaagctacaaataaaagctataaagaagataaacataaaattcagatttcattcattgataataataagtaaagatgagtacatttatgtagtcctaaaaatgtcaatcaaggataataattatccaagtgtcaacatcatattattctaacacaaattaaaaaaaaaactataattataaaatacatatttaactccatcctatataatccttggaccatttaattttgggcctagagcccatcctatcattacccaccggttcacattcaaccttgtcctcaaggtttgaaaacaactggaattgagagcaacagcttgttgcaaatgatgagtatgttgcttttgggggcaagaaaataattgtggatgggttttggaaattggtggcagtacatgaaaaaagaaaaggcttatgagacttgttttgatccagtggttggaagggaaatataactttatgagaaagtgcactatgtgggataagggagacacgtggatggtgttgatggttgttaggattttgaaaaaatttggtaagtggagatggtttagggaggatgtacatggcatggttggggtgggattttaacggcttagatgtgtggtaattggatcgttggagatctaagggatggtgatgcaattgagagagtgggagccagctgtgatgtgggagtgcacatgggtgaaaggacacatggtgatctagatgttttattttctaatatgatggacgggtgtgattggggaaggaggttaggttcaattgcaatgagattgggatcggtgcggctgggaaatttcccaagcgcaaaacattggttgccttttggtggtgtattgtgattgtggatttggagtgaacggtgaaggggattgtgggtggtgggttggggttgcaaaaattgaaaaggttgatgtggggaaaatagattttgttgcaacacccagcaagtgggtaaggtgatacagagatgcggttggggttggggttggggaaaatgttcatgagtggaacggttgtatgggaaatattgttaaagcaagggtacggagaggagaaactttgttgtggtggaaacagtggcgactgttgcggcggtggttgcgacggcggcgacagtggcggcgattgcggcagtggttgtggtgtctgatgttgaagatgagagcagagagttgcttcatcatgctatgcacggtggaggtgaaagtgtcatgaaaggaatcctgggaccttagatgggtagtgtgctgagatattttattttcttcatagtggttgagttggttctggaaggcatctaatttcggaaaataccttaaaggttgtcttccatggtggttgtggtggatttgggagggggagtaagatgatgaaagcaccattggatagagtgctaattctactctaccactactcctaagaaaacaccattaaacctacaaataaaagctataaagaagaatcataaaattcagatttcattcattgatagtaagtaaagatgagtacatttatatagtccaaaaaatgtgtctttacctaacaacttatagcttttgggattggtttattacaatgcccatagaatttgtaatatattccattagtttgtaaatgtaaagataaatataaatatattattactgaaaatataagaaattatttactatttgattaaatatactgataatgtctaatttatctaaaattagcttttacaccatcattatttataactaattatgattcaattgttagattgacaaaaattacatttagtagaaactattcattgctgttcatgcatcatgctacctgtgaatggggagattgtgaatttgtaaataggcccttgtggagtggtaatggtatgagctaatcttaaccattggataatggcttcaggttacatgatttcctaaaataaatacattactttgtcattaaatccctatcctgctgtctgaaatgttgaagatttagtctgactcataatagcccaatgctttctgtggagatgctattaccatgtaacccattcccacatgcatacctttctttttgggtttctgatttgtagaattcaacagggtagtgcagctgatgttgccatgtgtgctatgttgcaaatttccaagaataaacggttgaaggagcttgggtggaagttacttcttcaggtaatttagtgccccctaaatttcctttttttgtaaaaaaaataattctttctcgcttttattgtagtgtgtctgcaaattacaccttatctcacttgccattattctagagtcttgaatcaacaagcaattctatccattcttcctccctaagttgggagggggattggaggaatataagcattaatacgcaaacaagagcttggctgactcatattctataagcttctatgtaatcaataatttatgcatctgtcttctcaaaacattttctatggatcattggagaaattaagtgatgcctatgtagtccatcctttttttcttcttcttttcctgttgattattaatgacattatcttggttgtagttcttgttatcaaccaatgtaattgcagttacattacaacttgttccattggtgaattattccaccacaagaagtagttcgttttgccaactttttgaggcaatttccttaatctaaaagcaattaaacgatattagtaaccatatagttacaatttctatcaaccattatttttaatcagtatgttctgatattgaggttatttcaaatctgaatgtgttcagatatctattccaatcttgctgctttttcactaagattcttggatatgtcaaagcaggttcatgatgaagtcatattggaaggaccaacagaatcagctgaggttgcgaagtccatagttgttgagtgcatgtccaaacccttcaacggcaagaacattcttaaagttgacctctctgttgatgccaagtgtgctcaaaactggtactctgggaaatagtggtagactggtagtcccttatacagcatgaaaagccatgacaactgtttggagattttttctcattcagatatctttggctgcatggttcctttggtaattgcaatcaaaagatactgctactctggtgcctctattttcaaggcagaattggtatgccttaaatatcattatctgaggttgatttctatagaggtttttgacatcctaggaaattttccagtgttatgttttgataatataccaaagcataacacgttttgctttgaaggaagaaaaaggccaaaaccactggcctcggcgttttacttctctagttagcagttttttttgtttgtttgttttttttttttttttttgttttttttgcttctatattttgaatgtataccggtttttcatgccttgcatcatgtaccggtttgttgttttctcacttttctgaagatgcaaactatatcaatattgtatataaattattataaaaagaatctatctgcatttctgttgatctgttgcaaacatatacttctttgtagaaacatcatgcaatgataattggacgctcaaatagcactttgcatgcacaaatgatcagtatagccagtgacaattaaggttgacaactttcagtaatatcaagcagaattatgaatttatgatattctgtacaaatgaatttatgaatcttatgaacgagcgcaaaaatggcatacaagaatggaccatggacctactttaaccgttatgcatgcctggcaggagctaattaccttattattctttgatgaaaagtttgtcatttgatcatcatatataaaatctatgtagtgcaaactacgtaattgtcctctatttttgtgaaagagtaaactttcacttcccattccagtattttttatttatttacattttacatatcgtaagtgggttctattattaaacataattcatttttatttttcacaaactttcactttttcttgagtttaaataaaaaaaattaataataaataccattgaattaagaaagttaatgctagttaaaggcattccagtttccacccactatttttatgttcatgattaaaattattttcttcgtactgaattatgaatatttttggtggggaaaactaattttggcacacctaccacaatgatgtgaatcaaatcaaagcagtggacgtgcactccataatgagacgaggaaagtgtgtcaaaatgctggttggatatgacgttcttgaagaccttatgacacattgtattaagtatatttattgcgagaggaattttgtggagagttcaaaagtaaatttcaactgcataattatatataaatgaaaagttttttaaagtcataattactgaaattatataatttaaaaaaaaaaactcacataatttatatgctttagttatttatgataaaatataagagttaatatattttttatataaaaagctttgtcacttcatacatttcctttatccaaaaatccaaatagaagtttcgttttcggttaatttcagtgcaaagtattgttttgggtctgtttccaagccgcaatttccaaacgtacggacttcggaaccatgcgcttgttgtatagggcatgtggtagggtttggaccttgaatggtgtggtgaatagaaaatgtaccatgtttggtttaataagtggaaagaaagaaagaaaaaatgattttttagttatttggtagaatataaagtgaaaagaaaggaaaataagttcatcttctctaatttaattgagtagaaaataagaaacaaagatatattataaaataatataaatacctttaaacggaaataaacctaataaaaaataataacataaatatgcttccaataatacaaaaaaaaactagtcaaggtacaagataaattaaacaataataataacctaaaaaaatcatcaacttaaataaaataaaacaaaactagcaatattttataattcaaggattttttttcttttaactcaaatttacacactcccattctttctaaattcgaaataatcaaattttggcatcaaattcaccaaaaccttaattttcttccttaattatgtacaaattaatcacaaaatactttctttctattctttttctttcttcattttttttcattattgacatccaatgattttttgcaaattattaaatgtaattactgacgaaagttgggtttagcataagcttctaatccctcacaatatgatgaaataatgtttgaattcttgttggaagaggtgcactatgaaattgtacattgaacaaattgtctctaaaagaggatatatgtgaaaaacaaaacaaaaacgtaattattaagttgttattacagtaataaaatccttttagtgatttagttgtaaagtaaattaaaataatgaatattattatagaaatcaattttcttaaaataaagaggagcaactcactctctagattcaacacattcttttttttattggccaaaatttatcgacaactacaaaattttgagtgaacttattaaataaagggtaagactcaaacaatttataatttccaataattttaattaataataaaaacgtgttagaaaaaatataaaaaagagaccgcgttaagaaaaagaataagggaaaatatgtaactagcaattaacattaataataataaaataaataaatttttatcataattaaaaattattctcgagagtcatagtgtggtatgttaaattctcttatttatttattatttgtgataaacttttattataatcttcaattatgaagagagaaaaaaacacaagtgtgttgaaatgtttattttgttttatgttaccattagaagaataataagttaccccattgaatattcttttaataaataatagttttataaaatgttctgataatttaaaaattactatcacgtaatttataaatttttattaaatctaaaattatgaacatgtgaataacattgtagtactacaatagagtggagcgtgtactttaggatgatggcaggtaagtaataagtcggatcctgtcgccttggccggtttgtgaccacgtgattcttgttttgcccaactgtgaactcatcagccccaatttctgactttttgcccttttctcttgggatctcaaagttaggttttagattatttttttagtaacagtttaattaataaagttataaattataatcaatctatatatcacaacttttagatggattctttttatataaaaattaaattgcatgatttgattttaacttataaaaaaacttaatttattttactttttaattttctttctcttatttcaaacatacaattttattacaattgtaatcagtaattgagtaattgaacataaatgaattattaatatgttcagattaaaattgaatcatagaactaagttcaatttttacagacaatttttatattagtccagtttccctttttcaataaaaagtgaagggttaagaaaaaaaaaatatgacatcattaattcatccatctacattactaacttattgtagcaaattattttagcagtttgtcttaaatcaagtaataaaagaaagatagtgctagagagtggcattccatttggaatttccacccagtattctatgttgatgattatgatttgatttctccataatgagtggtgaatatttggtgggaaagttaacttttccacgacgatgatgtttgtgagtcaaatcaacacagcattggatgcgcacgctacaaaataagacacagagcctgttcctcaaagttggttggattagatatgatatgatgatttttttctagaacagaggcagtttctcaaactcgttgcctccgaactttcaatttcactgaattttagctcaaaaagttagcaaaaaagttccctacctctgttgggtctgtttcaaatctgcaattttcatacgtgtggagccataagcttgctatgtgtacgatacccaactttgtttttcctttatttgatcttacctctctttgtggatctaaaatgttgcttctttcttctgcagtgttacttgttagaattagatttccacactttgaagtgaggcaatttgattgaatttgaagttaatgcctttttgttcaaacgaaatcattggttttctgtttgtgtatgtatgcttattttagtttgtcaaatttgatgattcttgcgtttgatttagcttgtcttttggtgaagctgtattccttttatccttctctggttctattaatgtgggtagtgttttagatttgattctgcttcatcccaaccattgtgatttggtagtgaatttttgctatgtgggttagttctttttctctccccttgtttccatgataaattattatagttgagttggcattctcatcctgaagtatcaagtgtggttgttgttgtctcatggcatacaaagagagagtacattgcactgtataaatacctgttttgttttgaaatcgtgatgcacagtctataatgtttttgaattatttcagaattgttgttctgctgttgttgatttgatgctggaactatgtttttgttagtgaatctagtaactctccaccccatccccctttctcttgaaaattatgacgcatatctctttatttctatagctaggctttgtgtgggtaaatttatctttaagtacttataggaaaaagaaataaaaaagtaaaatagatcgaacttttttcataaattaaaattaatttttgcactttaacttttatagaagctaatttctaggaaagttaaagtgtataaaatgattttattgtatgaaagaagttcaattcatttactttcatattttattttctataagtatttgtatagaaatttatccaaacatagtcttaatacatgaaagataaaccaaaccaaataatttgttagaaatttatgactttacatctcaaatcacagggtgacactaatttgtaagtgtaacagatcactgaataattctgctgggagcattcatctcaaagactggaacatttggatattgaattggaggtgttactaataggagcatggctcagagtctggaaggtataaaaggtggaggaggatccatcaagctaggcaccactggaacaatcagttccttaatgacaagggaattggttcacatctcttctgcatcaaagaagcaggtatcttcaacaagaagtaaaactcaaacacttcctgtttctgttccctgtggcagtacaacccaaaaaagactacaacaaagaaaatcatcagttgaagccggtagcagtggaagcagtaaaactacaaaccgtagaggacctggcaatggcatgccccagaaaacaaaaactaatgccagaaatacacagagagtacccatgctaggttctgataaatgttcagtggtcagaactccagtgagggagaaaaatgataaaaagatacctaacattgttgaaattgtggacataaaatgtgggaatgcagaaaaggcttgggctacacctttggcaagtcgtcttaagaagctcggtttttcgaagctatccgagagcattatctagacctgaaatttttttgtgccagacttcaggttcctgtaactgaaggctgaggtcccatttggcctaccactgtctgatacatccaccatagaacacatacttggtaaaagcttgctacttcctctctttttctttgtactttcttctactgtagatacaattgtggttgtagaacttgtactaatggatgaactcacctctgtgatttgggacttgttcctttgtgaattggaaccaattctgctgaagtactcaatttcttgcattatgagtgatgcaactgtgcctctggttcctatttctactgggggaaatttatccttatcttttgtgtcatttgagtcaagggtagtggatttatgcatgcttttgttggttggtgttggggagaaagcaaaatcttttgatttaagggtggtttgtgggtttgttctagaggggaaactgcagagactttgaggcatttcttttgttacaggagatgtggtttcacaagaatgcttcaccttatgttctatatctgaaactgaaatccatggcataggtctatgtagatagatgggagattggttgatgacatagtcactgcattcatgtgcttgcagttataacactctagtcctaactactgtgccacctttttaagtttcatcatgttcctaagtacatgctactagctaggtcgttatttgaaactctggatctgatgggattcatgtgaaaggtaaaagtaggacgatctcttccattggcttttttaagtaaattggtgttttagttggcaaggaatagtaggttaactaaatcaggaaagcaactatttatttgagtgcttttcaggttaagggaattgtggattattttggttggctccatctattttgtaattttgtttcatatggggttctgcaggagtgtgagaaagatgtaacattatttacgaatctatatctatcaatgagttaagttgctattttgaaataagccaaaaaccatgctattaggaaaaccaagatgcaggattcatgtatcttaatttgcatccacaaggtgtgagacaagtgactattagcttgaatcttttaaatacatgatagacatttaatttttgattatgagaaaaaacaagtattcgtgagtaaaggaattactctttaaatagtactctacttttttaaaagattagtcttatggcttttgattatgaaaacactctgaattaaattccgaatctaaaaaaattgttaatttgcaactatagtatttgtgttagctgaatcttcctttggtatatttaaatattatcttcgttatggaatccatttcttccctttattctacttatctgcataaatttattgccaccctactttactaccaaaaagagagagcaagtttgaggaacttgtgtcttactcttcaaaaactgccaatcctactggacccttgtcacgacctttgctttggtgtcactcacgggtagtccatttcacttcttggccatagatttcattccataaggtggaaaaacaaaatcgttataaccaaagctaaggagtgtctcattcacgaaaaggaccaggaccttactattttatccatatagtgtgcattttaagaatatactagttccttcaaaattatacctatctttttgttgaggagataaaaacaactataaataggtgaggccatcgggttctcaaatcggataatatgaaagttaaagccaagatgattaatcaagttcggtttaaattttaagtaatccgaacaaatttatttttgtttggttcaagtcattcaattactaatgtaattgtacaataataattattaagtgtgaaaagaatcaagaaaaaattctaatcatattcttttactcaattgaaacatcttaaatcaaaagcaataaaatcaataaaactttttttaagaaaaaaatcctctcgactttgcaaagtgttgtgcaacagaattctcctctttctaaatcttgtcataggccaagcataatgccttcatttacatcatcgtagtgatgaatgataatgcatataaccaaaataaaacttcttatgatcacaatattgtagaggaaatcaacattgaaacatattatggcagaagatgaggataaataaaaatgtagaaaaaaaattacatgatctagtcaatgtaatcaacgtctagaggcagttagaaagattctatttcttgtatagagaacaatataaaactcttaaaatgtgaacaacacctctatttttaccctgactcataacctaataaactggttcatattccaaaaaaaaaaaaaaaaacacaaaaatgagtttggtctacatcgtggaggctctgccctcctaccctctcatgaggctcatagtttcaaattttgagctccacacattgcgttacaacttgaattgtccccgttagcaaaatacatatcaacatttcttcaccttgacttcaaagggtctcaagctatttgcaatcattcaccaagtccaaattatacttgaacgtctcagtagacaaaggccttgacaacatatccattaattttcagcaatggctatctttccatggagaacaacttatctttaatatcatcttgagttactttcaacctaatatcaatatgttttgattattttttaaaatgatagattgatagataaaattcttggccaaattcaatgcacatttactatcacaataaagaatatggcttggaacatctacacccaagttatcaatatgaccctacaaccgtatacattctttaactccttatgttaaagacgtgtattctaccccgatggctgacaaagcaattgatcgtgagacatttatagcatttttttaactccttatgttaaagatttgtatcaaatagtattattgtaactttagatgactttttttaggacttaattatagacgactttatgtagacagtcttagtgattttattattaattgacacttgtaatcatacacgtcaatattcgctttccggggggacaatgaatacattaaaaagggaatgttaaaacttaaaaagaaccaattccaaggggtactcgaaattgctttagtaaacattaacaatgattatgtaggtttgttttacgttactcctctccggtcccaaataaccgattatgtggtttaagcaagtccgagagggaaaacaacatttctagttacaaatgctgatttattttggtctgtatattgtatatgttcataaaatgagttttatatatgcactccaaaatgggtacaacttgtaagatacttaacgtaaaagttataagtggtgttattagtacgaaaactggcaatatgaattcatataaattttaaagtgaaacaatctaagtgttgcataaaaattcaggtacgcaagagagtgaaaaccgtccccagttaacttgttccgcaacacagattaaaaccttagtcaaatgttaatccctccgtcccgtgtcttatttgaagaaaaaaaaattatctcaaaataaatgttatatttaacttttcaatataatattaattattttttttttcacaaatatcatccctaacaagtgtttttttattttttaatgtaatattaatcttaagattaattttgtaaaattattattttttatctatttaataacttttttgtatctgtataaaataaaacatagttactgcttaaaataaagctcaagaagcttcttcaaagtgtcaagcacacttgtgaaaggattaagcgcaataggggagttgagtcctagatcaggaaattggtttgtaagtgcctgctgcattccggacatagacatcatagctgccaactgactattggacattacttcacaatcctgaggtgtatctttaattttgcttggatcatatccatagtttgcaaggtaagacttgtacttctctataaattcaggtccagggttaggtgtccttgagtatatctgcgatatagatcacagggaaattaacactacaagcaaaatcaaatcatacacttacatcctaattaatagctattaattaaagaactgtatgatgcagtattgtttctttaatttatcttaataataaattagctttagatgtcatatatgccatcgttgaaaattcagaaaaagccttttgaagttcaataactacaaacttaagctatattttttagttcagtaaatacctgaataaaacttttatccttagctccggaaacaagagaaaaattgtcataatcagtagcaatcacatcataaggttccttgggaatgaatggcaatgtaggaaagcggagatagcatttttcttttatcatttcctgcttctctagctgtgtctcagttttctccaaatcttctgaaagacattgaacccttcccctaattccagttataaatccattagggcctccatgaacacaaaaggtatcaacttggatggatggtgcttccctatcaaacgtatatacaccctgaaatgtcatagtatgcccaaattagtatcaagaagcttgtcgaagccaaataaggtaaatgataaatcttatctccaagatgtactaactgttatactactgaatgacagaattatccacacatgcataataaataatgaacaaccttagggttctgtctgtgcctccaaattcaacaatttattatgaataatatgaagttgattagggaaagatgttgaaagagcataaatataatgggctttttctaaaccaaatgacgtcctctatatttactgctatatttattttagcatttacctgagtgcaatgacagtcttcttggccttgtcccgcaaatccacgtttaagtgaagcaacttcaaaccatcttcctgaatatcttacagggtcaaagtcctttgctgtcattcctctcatcatcattagatttgaacctttttcattctcaaatggtgaagtaactgcattctcactgggaccggcaagttggcatatattatttggtgcacgagatagatctgctgcaatagtctgttaatgaagtaaatgagtacacattagatcagctcattcatcataagaatatacatctattttctagatttttttatcaatcaacaatatccagcctttgtaagaactcaaatatgggaaaaattcaagagtgatacaaaatatctatgcgagtaaagtgatccacatcagaaagtaatggcatcagataatgcaaaataattaatatttaatagcaatggcttttgctttgggcaatgtccatgtaattatggagttataaaaaagattatgaaccactatagctaaagtctctatacactaccatcagcaaagttttaacaaacaacttgtgatcgcgatttcggccacagcatcaaggttttcagagtcactgcaactgaatcgcaatcgcaattgcaatttgcagccacatcagttgcatttgtctacaatttcccgcaacatcaaggatcgcgatgaaactacaatttaacaatttaaaactttgctatcatgtatttgggaaaaaaaatactgtgagaacgttaagtaggtcctcctgatgggtattggacatatcacatcttgaaattgcatgattaactgaaatttcaatagtaagtagtaacactcttggattgtggaatacagtacaaacctgatttgctggagaaataaatatcaaggaagcagcaagcccagataagacatgctttgtcagaaacttacttgggacttccaatgagaacttcaccaatgtccttcctgacactatcctgcattgtctgtaaacaaaatgccatccaatttgcacaacaacagaaagataaattacaaaaataaaaataaaaaatcatacgatcccaggttgagtgagtatcatgttttagcaacagagttgatatttaacagtatctacaaatgaagagacaaaaaaatgcacttagaatcccaatgaaagaggaggaccacaaagaaagaaaaaaaagaaaggagtctgcaatctaattcactaaaagttggttattacacgacaaaattctgggagtatataaaggaaattcattcaggaatgctgtgtatatgaatatggaaaagctacattacataaactgaaaattgaagtccaccaaaaataaaaggaaccgaaaattaaatgtaagaaaaaaacagaaaaaagagtctgcaacaaacgtgggaaaaaaaatcattgttaaaatacttggaattaggagaaaattctaaaggaaaaatctaaggggtgttccagaatggaaaaacaaataaagggacataaacacaagttgagcaacaaaattagaacattaaatattgctaaagatgaaaatggggacatattagttggatttgttacctcggataagaagaagggtgaggtggaggaggtgatgctcgtagaagaagctctaccatgtctttgccttttcacttgtccacagttgcccattctgaactttctattctgcttggtttcactttcatgacaaaaatcctcttgaaacatcgtcgtccaaggtcccatgaatcaaactgggcctgtttgaactggacattcaaggcccaatctatgtacaaccactttaactaactaactgtattattcggttgaaggcttaaagctaactaacagttgatcctaacacctttcttctgaccaccaaatatagatgagtgttagcgcaggatattatctaacacacttttttctcatacactattttatcgattaattaaaaactttctttaaataaaaagtgaaaccaaaacaatttggtgttttctataaagttcaactaataataaaaatttagctagaaagagtgtaataacaagataaaatgaattgaacttctatataatctaaaatcaacttatgcaccataaattttatagaaattaaatgaaaaaacaaacttctatacaattaagtgtaaaagttaattttaacttttgaaagaacttgaatttattttatcttattttcttctcttataaataaatttattcaaataaaatcttaatatttacacattagtaaatgtgtgtaaggagtgttgaacaattaacatttatttatttatttaaattagaaaagaagtcagaaagcatttgctcagctagttgaaatatgagaacaattttgttatttttcttaattcataacattaataatataaaaaaaaaaacgtaggtttatttgtgtcgtgtgtttgctcatgcttgtatgtacgctcggcttgtaggacattaggaatagtgattgaattctaatttaagagaagtgattttttttccaattaattcctgattgcgttgttcattttgggtttataaggaaataataggcaggaacctcaactcatgaaaccgttttctttattggtggtgacgagaccaaagccaaaaaaataaatagtgggagagttaatggctaacgccaaatttagagaaaacatgtgaacaaattgagaagttctgggaataatttgttagatttggtcattttaattaggttatagacaacctttaaaaaaaactgtgtcaaaatgaggttttgctttattctgttttccataaagttactctcatccatgaattcgatcaagtgtattattccatttccacattaatcttatttaattaacaaccaaatgtcactttcagtgagtttggtaaactattttagttatctaataactttatgaatttatttgactaaagtatacgtgtttgatcaagaaatttatctcattagcttataacgtttatttattttctacttaaaataacgtaatttgtagcgtataatttaacataatattttcatttttatcattaatattttaataaaatttctcatatatagcttccttgttactatattaattcaatttatttttatttttaatacaatatttgatctgtaaataaaaaataataagagttcaacttcaacctaaaaacatgtatatttaaaactttttataacttccaattgattcatcaagtatttttgttaaacataactaattatcaaattatattaaaaccctacttattaagatttttttctcaaagcttattgtggactaaaactaatggaagaaaaagtctcttttaagctcaaaaatccctttgaggacgatagtgtttcagatattgacactcaatcgagtttatttgccataaaaaaaattgagttttttcttcttctacgataattgtgaaacatacgtattacaagatataataaactattgagtaagtagaggagatccttgcaggattgtatacaggagattgtcattgtataagaaataaagtcttgacatgcacatgctagtttttaggtcactgtattttattcaaataattttaataataaatgtagaaacaaccaatattactatttcttttattatatccacgagtatatgtactatttaaaaaaacttaatttgaaaagaaaaacaattgttagaaaattaaataagttaaatttttatggttctatagttgattatttgagtgcttatattttaaaaaaaaaatcattctattaagtgtgtcttttgaggttcttctcaacaaatgaagtgtgcaagatttccaaattaaattgtataaagatgatatgcaaacccaccgaaagtatttcacgtacaatacacgcattattgaattttaggaagacaaaaaccccaacttttacaaaacccactttgaaactttaccaaacttccacgatcaaataacacaaaaatcaatttacaaaggaccccatcactcaattacaccgattacaggtcttgcaattaagcataattccaagtcgtgtgcatttcactttctttctgtttgtcaacacgtatgttcgtattctaggcatcaacatctaacgcaaacttgtaaacctaattctagttagttgatcctgagttcaatttagtaaacctaattatcaacgacagtgttcgtagttacgtgtaagttagcgaaattaattatacttatatagtaattagcagtggttacatatatatactaatgtcagtttggtgagaaccttttcgttcatttcattacattatcctaactccatgatctatgtaactaacaaaataaattcatattaaaatatataaaatatattaaagatagataggttggtgggtttatataattaatcaataaaactttagctagataccttgctctagagtctaaacttttatagatggaccacattcaaaaaagggtagcatccctaagtaaagtataaggtcagtcatggatatagctaggttcatttagggcaacatttggaattacaaatattccacaataaattaatagcaaataggttttagatatgaagtggtgttctctatcttgggtcatcgaccagcgtgccacatttttttaaaaatattgtctaaatgtcacgcgtacagtaaattttaccagactgtcacattgcctatttcgctatgcagtccagcgaaatatgtgagctgacgtgacgtaattctggtgaccacatattttgttacaggggccagcgaaatacatgatcaaaacgagcaggacacgtggcaaacatgaggtatttcgctgaagagcccaacgaattacgtgtcaatagaaaaaaaaaaatctcaaaacttcaaacggtcataacttttgatagaattgtccgataaaggcgtacgatttgtcaaaacacttaaaattcagagaggaaaccctaggcaaagtccctaaggagatttgctccactattttttcttcttccaaaaaaacgtctctaagtgcctcaaaattaggatttaagcgtacaatatatccttcaaatagtctaacttttaataaaaatatcggatcgagacgtatgatatgtcaaaacactcaaaattaagaaaaataattttaaaaataaaaatagaattaaattaactaattaaataattaaaaaagtaaaaaaataagaaattttttggatgattgaatcctaaatcctaattttgatgtgaactagcgatgaaataacaaaaaatctaacagcatatttggattagcgttaatatatactggatccatgtttatccaaagctgttacaagtagcttctgcgtcattttagtgtttatattaacgtgaaaatcttcctgtacgtggatctaaaaggcaccctaagccaacggaacttctctactttatttacaataaccccgataatttgttaggcatgccccattgctctgataatctattatttgtgctactatagtcgattatatgcacactaaaatttgttatgtatgcccccaataatgtattatgcgtagataatctattatgtcctgcaaattggatcctataactatctaatattcatatgtgagagtttagagtttatatacaatgatggaatagaatttttatatctaatctaattcctcttttcttcttctatccaaatcaaacagtttcataatatatttttttcttttacttttacttatcttggacctaattaagaatctaaaattttatctaatttcttatttattactcttatttctatttttttactatcctatttttatttactttacttcttttctcgctggtgtaagtaatgttatctacaaatctatagtataattttgagtaaatattacctgcaagtaataatattttaaaggagaatcatgcatggccaattgggagacccatatacatatagtatgtccacatctgatgtgtagttggttatttaatttgaattttataatgtatattttaaatttgaatcatacattttggtgtcagggaaaagataggaagattgcagggttgcagcagcctttttctttatcaaatgtagttttcacttttttgctctcagtgtgatcagtagattcagatccaccaatcagagcagcaatctgtaatttgtctaatcataccaacaaattgatggtatactgtacccacttccactaataataacacaaacccaaatataattagcggttctgtggctcccttaaattcctaatgtgaaaattagttaaatactataaatctagtagaatctaatcatggtctattcttcactttttaaattagtctgaaatcaacttaatcaaatgtaaacattttattttctttctttttaattaattttactattatcatttgtaattgactttagcaaaactaattcaaaagcgcgtttaacttcacatacattagacgtgtctaacatgctaaataaaattttttgtgttattaacatgctaaataacaaacgtttgcttcttttggtaaatattttattaaatactagacgtgtttaacatgttaaatattaaatgtttagtttttttagtagatattttgttaaatattagacgcgtttaagtttactactattattaaataacagtatatattttcataatttcatgctaaaatgtattaaactttaaaatataaaatatataatattttaataaaaaattctgcactctttcaaattggtttttaatttataattttttggtacattgttaattttataatcttaatatcaaatcaaatacttataatattgtttattttaataataatacattgtactaatggggtggaatattctttatattcaacaaatatatttagcttataaaatatttaattcaaattaaagatataattatgttttatattttttttctttcaaaaaggataaatatgattagaatattaagtatgaacctctgatatttagaaactcttaaacagtgcagtcgtatttttattatttttttattttgagaagaacgtgaccattcactaacggttcaatcctttaatacatgtaatcattctcatcatgtcttcaattcaatttcaaactaatactagaatgctaataataatcagcaagaaatatcaaaataaaataatttccaactctttcagtcatgaatgttattatttaaagcacgggaattaaacaagaaattacgctacgtggtcacatcatgcgccctctccacagcagataactcctcatcacactcggtttttcaattcctatcctatatatcctcataagatgccgaatgcatcatgacaattgagaaagatacatatacttctctcataccacaccccataacactcttgttcgatttcttatacaagaaataaaatgataagagaagggataagtttgagataaaataacacaaatattcttgaacagccatgaacctttttgacatctaagagtggaagaaagaaaacagaaaaaaaaaaagatataataaaaaatatgatgtgataaaaaaataaaaaaataatgagtgctattttttcttacttttataaaaatatatttgtataaataatactacaactacaggttaaaggtgtgcaagaaaacactcagactgaatcgatcgagttgtaatcgaaccaattttcacctaaattatttttttttaaaaaagaactatattattgtactaaagaggttcggttaacctaattgttaataaaccaattttcatccaattaaatcagtttttttctttttataaaaataaaacagtcctaaaactcgttcaaaattagttcaattcttaaaattgatttaaaactgattcaaaatcaattcaatttacaattaatttttaaaattaattcaattttcgaaccaattatttataataatttgactatttggacttttgaatcggttaaaacagtttagaataaatttggttcgatttttttttttttttttgtaaggaataggtttttgcacaccccctactacaggttcatttaccatattacccatctctacgcagaaaccaagaaggcggcaatacggagagtttaggaaaccgaaatgaaaaataccggtcaactgtcccctatattaaacagtgggaccgagaaaccagactaatagaccaaacgcaccgcaacaagaagaacaacaaagaagaagattaggtactaactatctatctgttatgtgaatattcaccgagaagaaaccatgctcgatggcgaagaagatcattcacgacaccactaggaagatgtctcagctgtgccggaaaatcgttcaggtcgaagtccggtggggtgtcctcagaagggtatctttcgttggccactttttccgtttcatttggaacagacttcttgtttgctctgtcgccggaaggccatctcactaccggaaactagccctccgggacccctcttcttcgccgctggccaccgttgacgacgtcttctcctccgttgcaaccactactggcgactatgactccgattccgatttggtgaacctcaagatcagcttgttgggtgattgccatattggaaaaactacttttgtggtcagcatgtttctaactttaccatttcttttttgttttggtttttggaagaatttaacaagtgtgtactagaaatttaaaaacttttacatcattatcaacatggtatgacataattaacaaataaacaggaatcttaagcttgtattcaggcttcaatttcaggtctatgcatataagagactgtttttgtctccaaagattagtagataactctcaaccagaatactctcagcactcaatttttttatgtaatattaaaaaattacttttataaaattcttaagcttgtttatcatgagaattaacaaatttactatatatgagaaagtttgtgattagattctccctacatatattatttatttcttttgaaattggtcaagtgtagtagtcttttattttaacgggtctaattaactagcttgtggttatgtgaattcctattctcagatcaagtatgtggggaatgagcaagaaaagagaagcttacagatggaaggattgaatctaatggacaaaactttgtctgttcaaggagctcgtatttcgtttagaatatgggatgttgcaggttctttgcttaaactttacctttctttccctttatttttctctgttttgtctgtgtatactttttagttttcattctttttagtgttctgggtttgttggtttgagttaattgacttattgacggtgactttatattatgtggcgtgtgtaggagataaaaggtccttggatcaaattcccatggcttgtaaagatgcggttgcgattttgattatgttcgatctcaccagtcgttgtacactaaataggtaggctaagagatactattatctgtgtcatgagttaggtgaagggttcttacttcttagaaacgtaatggtagaaataatgatgatttgcgttttttgtactttgttatgttcgtgcagtgttgttcgatggtatagtgaagcaagacagtggaataaggtaccgtaaaaaataattttgcagggcttatatatagtactattacatgaattgattttatttcagaaagtgtctgccactgtttaaattaaagtgtagtttccaaaggcttttggcatggaaactctttttgtaaaacacgagagaaattttgaagtagcagtgcaaatggtttgagtatccacaggaaagtgacattaatttttttcattaagactggacagagaaatgaactctgattattgacttgccggggtatactattttttcaagatatcaaaatggcttgttaatataactaaatattctgttttaggctgataatatccaaattttgaagattttgacgtattttttatgaaatttctgatgacatttaatctgttcaatttgcagactgcaattccaattctaataggaaccaagtttgacgattttgttagacttcccccagatgtgcaatggacaattgtaacagaggtaaatcaatgaaataataacaattactgctgcaaattaggttttggtaacttaatttctcttaatcatagtacatatatggatgggggctgctttacttgccttggtcattttcacctattgactcgggaacaaagaataattcttctagtaataaataggagtcttatttggaacctcagcatgtgtcatttatgaaagttccatgtttccgcgtttaacattaactttggggcttacatgttgattaaagtcggatcagtgatgtgttcacagttcactactttcactttaaataaagttaatactacaactttttatcacattccttggtttttcaatgtttaacctggtacgtcacataaatacaggcaaggggatatgcaagggcgatgaaggcaacccttttcttttcaagtgcaacccacaacataaacgtcaacaaaattttcaagtttatcatggccaagctctttaacttaccatggacagtggaacgaaatttgaaacttggagaacccataattgacttctaaattgttctttacacactgattcgtatgtatatagcaggacaaaggagaataaaaaatagaatgagaaagaaagaaaacaagtcaactttttcatatatattggctgggacctatcaccattcaccacctagatacctaatttacatgtctcaatatataggccattttgactatacgtctttaggcttacccctgttgtggctgaggtcaaagcccacaggtcttgataattttatttctacgtgccctgataaaggagaaattctatttccatataacttttgtatgatattttttttattcatttaatgttactctctaacacattttcttttataattgttcaatatttctaagaaattatagtattacgagtgagaataactgaataaagagtaaaacctagatgaatgtgtaatgtgttgtttatatttgtcttgattttgaagtgatgtaatatctttgaatgtgatttatagtgatgcaattatgttgaatgtttttattgtaaaagcatatatatatatatatatatatatatatataaattttcctttttttttttgtcgttatatgaatcacttaaatttataatagtcgttaaatttaactaaatttaatgttcctgaattcatttaaggaaaagttaagttattgacattaatattatttttatatataattttaatattggatagtaatattttatttatgatataattttattttaaattaataattaaggatagaaattaaataataagttatatgtgattatattcaatctttttttttcaaatcttaaatactataataataataatttgattattattgttattaaaattaaaataatagtctatattaatatatatatatatatatatataacttcaattgaaatattaagaaccataatattaatattttgatttcataataatcgttaatctaatttaattatgtaaccttcattttaatatatttttacataaaaaacaaagcaatagtatcatgtcaactaaaagtagtttcatataatattcttagtttatattttaaaattttgatatttatctaatacatataaatttgacttgttaaaaagttcaaattttatttatttaatttttagaaagatatttattttcatcaaatgcaacagcatgtcatttaaaagaaattttaaatatcattttaatttacattttttttacattatgtaaaaaatataaatatattatatatttttaagaacttcattttttatttattttatatttattttcatctttaaaaagagaaagaaatgcgcaaagtaatatatattaattaaaggaacatttagttagccttcctcccgtgttcaataggaacccaatacacaattcctaagaaaagaaaacaagtactatgtcatataaagctgatgtaaattgcgtatttttaagtaaccaccaaattcaataccctcatgtaattaaacttacgaaatctaaaaaatgaatacacagcttgatgaaatcagtgaaataaagtcttagcagcaaagagatgttataacatcatatcgactttgttgtcgagtttatacactaacatttaatgtagcacccagtcacacattcacaatactctcaaattaaaatattattactaatttattaacagattgatatctccaagtttcttgaagcccttggaactgtcaacaaaaattctgcatctttacggaatcgaggttccatggtcctaccagaatcatctttcaacatgtttatactaacccttttcaacatatccccattaccgatgaaatacatgagcacaaaaagttcattctcagttccacagaacccattaatctccaccacttccagacttgaactcaagcttgcataaactcccacgttgtccctccagaatcgcgtgcggttaaacagaaacggtgtttcataatcctaagtacattatatgtaacaaaaaattagcagctttttttatttttcaaatgaaaaaaccacacatataggcaaagcaaattttaaaaccacacatataggcaaagcaaattcaaaaacctaatatatataaaggataaacaaattcaatgtatgtgattgatactcacaaacaaatttttttcggaacatagatcaatggtgagacactctaacatcgggcaactgttgaggaagaatgtgattcccaaaaactcgttcttgtccaaagccgtcttcaagatcaaatgttgcacaagcatgtcacttcgaaaacctagcagttcgggtccggtaggaataatcttatcgcatcacacacaaaaaaacgttaattgaaaccatcaacaaatcattttgtaattagatatttcaattcagtgaaaaagaaatggaacaaattgatcaaaagagtggaactctgaaagttataattataaaagtagaatatatgataacgtacaattaagaaattaatatcaatagagaaaaggtgatgaagaatgtatacctgaagaacaaaactgcatacagtcaaaactctaacaatagatagattttccaccagattataaagaggatgaccaaatccttcgaagccatattcttgagagaaatcaatatttgcctcttccattgagtgtgaatgaatttccgtgatgaaaaagttcattaacccacagtactggaaaatttttagatctggtgcgttcacttggaaaacatcaaattcaaagcggcacttgtccaggacaagctttctaagacccttatgttgttcgtcgcctaggtcaaacttgtctgagttccaacaacttttaaaactcaaactctccagcatgttacaattggaaagcaaagctttgctagcactgagtctcacttccatccaacccaaagaaacttctttgagtgcatgaaagttaagcacttcagtctcaacaaaactacaagaatatagcttcaaagactcaaggctaccatgctggtaaactcgtgctggcaattgaaactgcgcctcgtcataattaccataataattttcattccagttcggatcagcaaagtcaagttccaactccttcaccccacgttctgtggcaaaaacagcgcattgatcaatgatctcaccagcatttctaggatttcataacctaaaagagaacttctccaccaaagttcctttgtgattttcaatccacaaattaatgaagtcaagaaaagtccttctttggatttctcttgtttcattaggttgatcaggtttaacaaaaaagagttcatcaaactctatgttttttgtgaacttgcaaacgttcaactccaaccatttcttcgagaggatagaagttctcacagcttccttgaagggaagaagtgaaacgatagttataagcaattccattggcaacgaatagatgctcattgccatggttctagctatatgatatggtgattgataataaagatgtggataagactattagggtactgaatttttcttcaaatattccaatgggattgaaatgtgtgtgtgaaatggccaatgagtgctaccttatatatgcaacagacgttgcttcagtgagaaaacaatgttgcatacttctatatggatttttgtattttttttttcttttctgtaaattccatgtatacgttgccgttattagaattttttttaggaaaacataaatatatatattaattaattactataatatattactgttggatttagaatgaaggcaacctttggtgaaaatgcataaaattttaatgggattgttttcttcatttgtgtttttcttttttgtagattgtatatatccattaattaatttcctcaagtcccacaatggtttccattgttttttttacggtcaatggtttccatggttagcaataaattttaagaaatatttgcaatcaattactttacatttgttatttgtatttcaaatatttttaatgaattcaacctacgtttacagtttttatatgttgcataaagtaaatgatcagtttttatataaattttgtgtgtgtattaattgaagaaagagagaatgtgagggcaaataaaagaagaaagagaaacaaataaatgtgaactagtgtaggatcattaatattttaagattaattaattagttgtacatgtattaattattttaagagtctaatttttaaatattaattgtttgtgtaaaaattctcatccaaataaaaattactctattcatttcaaaataaatctcagtctgtttttttattcttacacagacaaagaaagttaataaatagataaaaaaagagtagtaatttttttataaaaaaaaaatgttaatgagtatcctaagattaagaaagtaaaagaggataatatatattattggaaacagtgaaaaaagtgttttcctatgatatttaaatgcactccgcatgattttcaatataaattttcctatttttgatttcttaattagtgttcttagaatcacaaaattcattttataaaactaaacttattattaatgttatattgaaaagctaaattaaacttattaggagtattattgaaaaaaagtaattgatattaaattggaaagttaacataacactgattttaggataatatttatttttaaatataacacttattttgggatggaagaagttcaataaaattatttttggtctaagaattatttgatttaaaatttattttaatgttaaaacttaaaataagaatttcaaaaataaagaaaaaattgttggcttaatatgttttccatatgtgtaatattttccatttgtatttcactatctaaccttttttttttattacctgaaatattttatgtttgactttagtatcatttgtcagtcagactttgttaatattaaatataatattaattaaaaaattaatgctaattataaaagataaaatatttaaaaacttctatattatttttcaataatactatttttatatggtaaaaataataaacttaataatttttatattatttggaaagtaatttaataaatatatatttagaactttgaaacttaaacataaataaaaaaatttaaagataatttacaaatagtatattatatataatattaattaaaaaatcagtattagttataaaagataaaatatttaaaaacttctatattattttttaataatactatttttatatggtaaaataatgtatttaaatcaaatttaagaatttaatatcatttgaaaaataatttaacatatataccattttaatttagaattttgaaacttaaccacaaattaaaatcttaagaaatattttggaatgtaaattaaatcaataacttctatatgactgatatgacataattacacttttaatcacttataattatgatacataaaatactagaaatataattaagacatgtcaatttgttttttaaataacatgttaaatgtcacttcatcgacatgtgcttatttagtgtcacataagaaaaatttattaaatattttaaaaaaagtatgaaaaaaagactaaaaatgcataattaattgtgacatttaaaagattcaattcacgcaactgtgccttcagagtccaaaatcactaaatcatgatatatctaatgtatcaaaaataaaattaagcctaaaaatgtctaagacttgatatatatatatatatatatatatatatatatattataattagtagcatactagttataaagtttttactataatttaaatttaaaaaaagtaagccatagatgagaagtaccacttgctccctgacttaccccaagttaaaaacactttgcaaattctaccaagttagtatatcaattttgttttagattacactatctcaataaaaagaaaaaaaaattattatttctcttgccataaaagcaacaaacttggattctgtcttcatgattctttgtccttttgataaaatactacataacataaatctgcatagcttttagattgtatctgtcaatatccacgcttgatatatattgatattagaatgcacataaatactaaattttagccttaaaagaatgaaaaatcttaagctgaaacacaattaaaagctattattgtaaaatgaattttttaaataacatatatatatatatatatatatatatatatgcatctaatgaaatctgtgaaatctaaataaaatgcgtttatataatatagacaaatgtcttgtattaataagtaacgtttgcaaactaaaaatgcataacaacaaagaccaggattagcacttaaacatataacatggtaagttgtttttttttttttgaataaaaagttgaaggttctataaaataatattaaagatagagtactttttcaagacattcaaacactttcttcaaaatgtaaattacatccgcaacccctagttttgcttaaatttcatcttatactctttcctttttgcacctacaaaaaatcttttaattgtttagctcacattacacccagaccccctccatcctaaacaccgtttaataatttaacagaaaataggcacatgctggtcatatgacttttaatgaaattttatgtttaaaataccctcatcttcttcctctcaacctgaaaatattttaagactcttatttttttctctaattaaatgtgaatccatctttttgttaaacgtgaatccaccttcttgatacgcagtattaaccctcttccttcttcttcttcaattttttagttcagtttttttctctgattgaatataatcatttgcttcaaatttagtattttgttcctacatttgtgttcttatggaaccaaacatcaacactattttaatcaataataataaacaaatgattttcagttcatcccaaatatcaatactattttagtcaataatgataaacaaatgattttaaatatcataagtggtcccaaactgatcctctatttaaaccccattcagaaatagacaacaataaacaatcaaaattaaataaatattcttaaaaagaatctatatacaaggttcaatagtcacttacaagcagaattctagtgtgaacagaaatcgtggaacataaagagaaacagaggaacagtggagaactcgcgtactggaagagaaacgatgaagaactcatgaatggtgaagaggaatagaacgtgaacttcatgagaggaagaggaactcgcaccctgtggacattaaagaaaactcgccaacaagaggaagatgaatattacttgtgaataaggaaaatgaattaaaggtaaaccctaaattttgaaactaattgggaggggataattttaattttacaattaaaatataaggataatttcgtctgctcacatattttaattgatgttagttaactgcgttaacagaaggaggtaaaagtaatatgaaaaaagagagaggtatcaggtgaaatttgagtaaaatacaagggatacgagtgtaatttccttaactatgtgttaaaagattgatatctctgagtttctgccatttgacggcaatgagactccacagtcttaccggaatcatccttcaacatgtttatgctactctttttcaagacaaatccacgaaagatcaaatacttgagcaagaggtgttcatttagagttcctctaaagccattaatttccaccacttctcgacttgaactcaatcattcacaaacatccaaatattcaatccagaattgtgtgctgttaaaataaaacggtggttcataatcctacaatatacaacagaaattagactccttttttgttaatagaaaataaccacaacatatattgatgtgttaaaagcaaattcaaaacttaacacacacacacatatatatgtatataggaaaaacaaattggatttacgtaattgatactcacaaacaactcattatgttgcaaggccatcttcatgatcacatgtacatccatgtcaggttccatacgttcgggaccagtaggaatcaccttaaaatatcacacacaatacgttaattaaaacaatttagataagatagatattgtaattaatccatatttcagttcatccaaacagaaatggagcacgtcaaaagagtgaaagttatcatggactataagcgtaactatacacttatacataattataaaactagtactaatatatgataacaattgacaaattaattatgagggaggaaaaggtgatgatcatgaagaatttagcacaaaactacttacagtcaaaactttagcagtacaaacatcttccacgaaactgtagataggataaccaaatccttcaaatgaatattctagagagaaatcaagatctatctcttccattgcgagtgaatcaatttctatgagctaggtcaaagttcatccacccgcaatacttgaaaattttgagatttgtttcagtaattgactttgaaataatcaaaatcaaagccgcattagtccaggacgagctttgtcagatccatgtgtttttctttacctaggtcaaacttgtctgaattccaacaccttttaaaactcaaactctccagcatgttacaattggaaagcaaagccttgatagcactgagtctcacttccatccaacccaaagaaatttgtttgagcacgagaattaaacactttagtctcaataaaactacatgaatatatatagcttcaaagactcaaggcttaaatgagtgtatcttatgtattttcctatcaaacatgtagtaaatacaagtgatttgacaaaatgaagaaacacccatgcctagaaatagcatataggaaaatattcaatttacacactttctttttcatacatctctttttcattttagttttatctctatttttcatcacatctatcactttatctctcttttttctttatttctctttcttccttccacctcatgccatctcttttttgggtttacatttatcaggttcacagcatacataagagtgattctttcaaatggaacttgttagttgtagtgaccatatagacatggacgctcaaacttttatgctactatctagattcaacgataagtaaatctaaacttaagtgtggtgatccaaaatataaacaaattaatcttaattaatttcactctatttaatggtattctttctaaaatattctttaattaatttagattttatttttaacaaccttatattattgcgatatgaatcgtatgactttcaaaatagagaaagtattatcattcgaaacaagttctcctaaaattgaagtatttcatcagtaagcatgaaaggtagtttaggaaatgaagttcattttttaaatgagattagtctcatattactaatctattatttgtcagtggcatatttctcactcaaaatttcataagctcctgatacaactttcactgagtctatgttagctcaatttgagacacagcaaaaaccaaagctacatacaagaatcacccaccccaaagtaatgattctcataaattgtctgatggtgtgaggtgaggtgagcaatcttcaagccattaaaaatattataaatacattagattatgtttcttcattaattctcaaaaaattgaccgaaatccaattattattagatggcctagagagagattgacagtgcatgaattaagtagtgcagaagtaagaattataaagttgatttggtggttgaaggaaaaaagatgttgtaagttcgaattcgctcactaacaaaaactaacgaataacatttatcgataaaaaaaaaaataggacagaagtataatcacggagcaacacggacacggggcagttaactgggcctccatctgctaatcaaaggttaatttaaagcaagaatgacccaaaaatataaattaaagctccagccagcatcttcactagtgttagcaagcattaatgggaatcataacgaccattataaacaagatcaccgtactttgattattattaagaaaaccttattataatatgccatgcatgtcttgagaaattatcctcagaccaaacaaatacagatgtttattcctcaaacttaatgataattcagaaatagaggggggcaaaaaactaataatctctaataataatgttccacagctgtgtcatcattattaattattatgtacaattaggcagacagccggatcaaccagtctttaccataatccagctaccacattccaaaactaacttccttatcggtgaccttgtatgaccacatgtaaagaagttcggggataattctcaattcctcaaccctactgatttgcctgcaaaaaatgagtagaatgagagattgtgtatacctgcaactaaaattgttgttttcaaaagaaaaccacattataagcaatccacatagtcagtactctgtttcttactttcttaccaccaatctttttcttgatatttcaaggccctccacaacaaactatatttaaaaagatactaaacatgtgaacaaatggattggtgcagtcaacttttgaagctttgatatgctaattcgtaataacatagatttagaaaaggaataaaaactatggtgggttcaaaccaatagcagttaggtcataggcggcaattcaaagtgaagctacttaataaaaatcagatcacctaatttagaatagctccatcactcaattctaacctatgactataaatctcaaatttttccttctagtgtacttacaaaatcaaattgttccaccaaatatcttttgaagtataattccaagacagtttgcacactagtattagacagtgtaggttcctccacctaatcacccaatgtctaacaacacaatctatgtcacccctgaagctagcctccaaaaccaacctaatacaacctttgaaaaggatcctccaaggctccaaccaataagaggtaagagtatgagcatgtatatggttcatttagtgcatgatatggccaaggggcacaatagttaacaataaaatatcactatagaaaattctcatctagataatacctgtgaatacaagaaggttccgaagatggcaatagcagctcctagagcattaataggctgaactggtgtgtggaagataatgattgaagaaactataacagatatacgtttcatggtgtttccaatgctaaatgtcaagggagagatctcatccagagacatgtatgacacttgattgtacagatgataaaatatgctctgagctgccacccacctgttgtgcacaagtagcagccatatgtttaatcataagacaaaacaatgcagaagattttcagaaccacaagtgaaaggacaagaatattagataactcaaaatcaaaaacaaaagaactcaggtcaatttcccgtttgaaaatccaaacacataaatcaggtttcacaccagcttcacggtcagcagcatatgtgtatgtgaaggtgagaactcttaatttttgtgagaaatgaaaacattggattacaactgttagattgaaataaactgttaattgcatatttaatttccaatctcacatgatctttgattaaaaaggaaaaaatcacgtgaggtttacaattaaataaacaatttgaactgaaaatttaaaatcaaatttttataatgaaatgtttgcatttctcaaaataaccaagaacaattaagatttaaaacaaaaatcatgcaactttttagtcatgctacttttatgtagcttttaatgttgatcatctatgactagttatacgaaaaaagatttgctctaatttctaataactacaaagcaactccataaacaatccaaccacttccaccttaccttctcctgctctgagatagtgtacacattacaaaaacaaatgaactaataatttgcgcaacatccaataaatttgaatttctgaaaaggacacaagatgccgacaataattgtcggaaaaaaaatattatgaatttatgacaatttcaagatatcacctttacagaaacatagcatagataacatcagatagagtagacattttgtaattaccatattatttggggtccaatttgagagagtgctgtttgccatccagctgcccacatctgtggtccctccacagcaatcgcaaatggtgtgagaattacaagggacaacatagataaacaaccatagtaattcattccactaatatcctttcccttcatgccctttttcgaatagatattacggagtacaaatgccaaatttgatatcatagcccccataaaacctgaaaaatataataaaacagtaatgaaatcaaaaccaggagggtgtgaaggactcctatgcagaaaagatgaaaagttatgtacattccatcataacctctgctaatggcataaacacccaagaatcttatataatagtaaatcatccattccgttggtggctcaacacaagcatgaacacataataattaaaatatatacatagaattccagtaataatcactttgcttgtggaggaagaaggggaagggtattgtgacattgccttaatcaataacttgccatcaaattatcttctctcgggtcaaattttttagttcaactcagattatcttctcatatccaacttttatactatgttcaacaacaaaatacaaaatagaacaaaattagataacaaatcatttttttgttagaaaagcaacttctttaccaatcatattgaaattgagctcagtcacagctgcaagagcacatccaccgatgattggaatcaaagacaggtagactggcgctgggaattcctcgcccattagtctggaaaccattacactgaaagcaggctcagcactcttaataatatgggtgaatgatacggcaacttttgacatgctaacagttgccgctacatgtcctattgtatgtaaaacagcaacctgcgggggaaaacagcaaacactaaggtcccaatccatatcaagatgttaataaacaaataaataaatagggggaaaagccaaaacgattcaagttcttaattaaattgcggtcacagacgcggtctaggtttcatcaggatctttgatattgcggcgaattgcagccacaaaggccacaaaagccttgacattgcggccaaaatcactgtcacaaacaattttctaaaacctttccaaaacttaaatttccatcgttaaaaaaaaaatctctctggtaaacctcctcccattcatcaacatagtttaaatgaattaacttttctctttctctttttcatgaaatcgtcaagcttccctgaagtcaaaccacacacacacacacacacacacacacagagatatatatatcaaaacatgggacaaaatagttcttaaaaaaaatgttttccccagaacaagtacacgtaaattataacaaatgaacaaacaaaaaagtatgctttcattttctcccatcaaatttatcctgaggaaacaaacaaaagtgagtcacttacagggaacaaattcttccagaactgaagatcagtcttaggaggctcaactatcttggtggcccaacagaacaacattatgagagagccacatgcaagggagagagttgaggtaagccaagggtatgggaatgcattcagcaccttcttgttataaatgttgaacaccacattcagtgcccaccatgttgcaaagtatatcccaatcttcaccttcttagcagcctctgatggagccccagcccctccaacctctgatctatcagcctcataagcctcacatgtcacgaaatcagcacgctcacgcctcaccagagacccaacgaaatctccaaaaccaacacgagaaaggtgcagtggcttttgcactgacaccaatgatctcagagagtttttttcccttgaagaaggtgaaacaagggaacatgactgaactggggttgaagctgaacactttttacgcaggaaaagatcagaacctctgatggatatggcgggttgtttcacggtgcaaatcatggtgtgcgatcacactgatgaaacgatgaaaaatatatttaaaaactaacaataaaaatctaaactttctgacgagaaccttaatgggttgctaaacaattgatgggagaataaaaaaacgagagaagaaagtagggatcccgtgcgaatgtgtcagtgtcagagccgtgatacgaactctcacggactgagcactattttttttatgtgatttgagaatgttgctgtgatgatttggctcaatgtgaatgtgatgcccctctgagatcctcagatgtttagtttagtgcaaatcgaagttactgcggcagaatccgataaacttactaggttgttaccttaatttagaaaagatcaagcataaaaatagaaaagatatggtaaactttttaaggatcgatgactaggaatctgttttgggagatgctgagacgaagggatatattgaatcaggatttttaaatatttttaaatagtataaataaacattttagattgaatcaggatttttaaatattttaaagtattataaataaactttttagattgaatcaggatttttaaatatttttaaataatataaataaactttttagaattcaattaagatggttaagatttttaaaaaaataataaattttagtgttaattaattatgattttttataatttataaaaagttttttgttaaaaaatacatataaattttgatagattatattttaagattttgacagatattatcataatttttaggataaaatatctatcaaaattttgatagattattttttaaaatttggatgaattttattgtactttttagtataaaatatttatcaaataatttcatccaaatttttaaaatttgatagattattttttaaaatttggatgaattttattgtactttttagtataaaatatttatcaaataatttcatccaaatttttaaaatttgataaattattttttaaaatttggatgaattttattgtactttttagtataaaatatttatcaaataatttcatccaaatttttaaaattctattggacttttttcttatttttttattgattaacatattttcttttctctcatcacacgtatttttttctctttttaatatttttaaagatgtgtgtatcatatgtttctcctattcttttgaaataaaaaaaatgttaattatatttttttttctctgcattttttcctttgttttctaattaaattaccatattatattcatcacttgttcaactcaatatttttgtgactgtcatctttaatttcatcatccacatacttagtaactctcttaccaatttttcactctaactactctcttatagtatatttttattattgcatcccatttaaatatatcattaaatttatcataaaataattttaatatttttaaaataataaaaaaccaaagtataattttaaatctacttttaaattcaaaagtgaaaataagaagatgttaatataagaagacataaaactaaaatcaatatagttattaaaaaattaaaaaatatattaattttacttttttatccaaacctcattatttcttattattttttcactaaactcttatgaatgtatttttaaaattttatagaatccttttaaatctaataaatctataaagttttttaaaaaaataaattcttatgatataaatctattaaaattcaaattatcataaaagtcttataaaaaaatctgataactcataatattcatatataatctttaaattttataaagatttttttatactaaaataatctcttaaaaatttaatccaataaaacccgaaatccactatcctataataaaaaaacatcttcttgcacacgtgtctccctctcattcactctcaaggctaaaatctgatgtgtcactctgaggttaattctcagcttcagcttcttttttcttttcttttttttttcctcacacaacacacacacactcggggctgagctcttctctcatcagaatgagaagattcaaaatttgaaaattttcaaaatttgaatgaaatacacaaaagctgtctatgagacagagtttgcagcctactgtgcctattatgtcacctcgccgagctatggagctgaccaccaagaagcaccatttttcaagcaaatgcattcctcagttcttccatttttcatatttttcacttcacctcagcgtcttccaccagtgtgtgacaatagctcttcacggtttgttcctcaggtcttgcatttctgatacttttcttgtctgtggtatgttattactttgggaatcaccattttctttaccttccttgcttctggtattttagcttttcagcttggttttggtaacttcttttagtcatatttggttttctttttttctttttgcctctgctatgttacttcttgaatcgcggttgaaaacactttcgttgctttcggttttttttttttttttttgccgtgcttgccatgttcaatgttgtaatgaagcaagatattggctgacttctttgtgtatcatctatcaaacatttgtaaaactcttattttgtatgtgggctaaacctcttatttgtttgtgtaacttctgtggtttgttattatgttgattttgttgagtgatatattttacttatgatgcttttttgattgtgttagtcagtatatcagaaaatcatccagtgtgttactttaacagttcagttgtttttgactttttctacttctattcgtctacatcttagtgaaactgtctttgttatcagcctataaaatgttgtacatctttgttaatggactcacatacttacttatttgtgtatgacccattaaacatacggttttttttttcaggtgtccgtaaaaatattaaataataccagacttttaatctggataatatctccattttcaacttggttattaatggctggcggtaagtttttaacatattaaacaacaaatatttttttctatgtccataaaattacccagttgttatttgtgtatttggttagtagtatttcgcaggttgaattctataggcgaaattaatgattccaaggaaacttggaagattgctattcgagtgataaacatgtggactatacctagatcacctaagtctacgactgagcttaaactaattgacaaggaggtaaggatatgttgtgtccataatttgtattatgaaggttaaataatgatatacaatattgtggtacttaagtgttgtttgtacagggtgatcagattgtagctcagatgaagaatgttgatgataaagtgcttaatgtcaattttgaaattggtcaaacatatgtgattcaaaactttaaggtggaaacaaacagtggttagtacaaggctacgcgacatgcttttaaattaaactttgtaaaagcaaccaaagctacgccccatgatttacctgaaataccaaacacaatgtacacattcacaatgtttgatgccattcataatggctctgccacacctgattatttaataggtaacctctgttgtaaaatttgtagtgcattattaacctttaattaatttggtggtttaacataatttggtttttcctttaagatgttattggtgaggtagttcaaatttgtcagtggaatcttgaaggacagcctaagaaagtgattttcacaatgaaggatgagtggtattgattattcaaattggtgttttacctcctgatatattctttatgaagtctgttatacattgtctttcgtattatagtttatgttattatgtgtctcaattgtgacacagtggtagtgaaattagttgtactttatgggaggcacttgctgtggaatttaaggagtattttgaaaaagcattgcctggaccattcatattaattctgactatggcaaaaataaaggaacctagaggtatgttaccttataagtaatacatgttcaatgtatgcttcaatgtagttaaacattaattttatacttcctgatttaatgcaggcaattatcctgtaggaattcagaattcaatgtatggatccaaaatatttgtagacaatgatatgaaggatattttggaattcaagaataggttggatttttattttggttaatattgttatcacatacattgttgtattttaacatatttgttatgattgaacaaattttttcagaatggatccaagtcagttaagcacttatacatgttcccaaataggaagtcaaatgtcaggttcttcaatctatgctgtggcagatcggtttctttataaagcttgtgtaaaatctttagatcaacttgcccaattaaaaaaggtttgataaaaatttcagagtctgttaactgcagtttgcataaactgatttatttattttgttgaaggatgatgtttgtgtcactgttgctactatatctaaattattggtagccaatggttggatttatgatgcatgccctaaatgcaacaaaaaggttaatgcacaagctgagccttttatttgtgttggatgtggtaatgaaagtggaaagacaatgccaaggttagtagattatatataatttataatgtgtccataaaatacaaatagcttgacataagtcagaaattcagttttgttttttgtaataggtttcgtatagatgtcagagtatctcagcctggtgaaactgctatttttacactttgggatcgagagtgtgttgctttgattcaagaaactgcagctgacatcaaagagaaaatgattactgaggttatgctggctatatctatcattttataggctaattttccttataattcattatattgtaatatattgtaattgattgtaaaacattgataattgtctttgcataggaagggcaatttgatccaagagatatcccggaagctcttgacaatatactgggcaaaacttgtgcctttcgattcaaagttgttccaggaaatacacgtcattctatctctcagttatctgaagataatggattaataaagtctgtgcttgccaaactatcaacgtctacccttccggtatatatatttgtatgtgtgtttgtgtatttattaaatttatgcactcaagaaaccagttagtaattaaatctttttgtttttatttaggatgatcgtcagccttccttgtcatcagcatcccaaactaatgatcttcttgatagtgcaagtgatttgatgttttttttttagtttcattgtttttacacacaccagtgattcctgtcgactaattcaattcattccatggttggcttgcagcaatgcttctcagcgactgctgagtctgatccaaatttattgtcttcaatgacaccagctaagcgtatttgtaccaatactgatagccaattggatggcattccatttgaagatttatcacaaatcgaactatcttgtactaggatgaaaaaacatatcaagcaggagtcatgatgatgacgtgttattgaagacttgtggggtttttttgtttcttaggaccattgtattaaatagtatgggtttattttggcactttttgatacatttgtgttgtaatacgatgtgatccagacattatttttgtctttaatacaatgtacttattttataattatatctgcaatatctgcaatgttcacgagtacaacatttccagcttcttcttcctttctcagtttgcttccagggttatgttaaacaacagtctataaacttggtattgtacattgtgtatgcaatttataaatttagctgagttgacatcaaagaataattattgaaggcattcattttatttacaccaattgaatcggagctgaatattatattttagtgttgtaaatataagaaagtcatatgtttatgcaccatgactacatgactttttcttccaggattatgccatagtggaccagtatttgacgtgaataatattttacaccagctgatacattatacattgtattctataatattcagctattagtcttgtggatggaaaattagaccaattaaaattaatatgatgttcacgaaaagaaaaacaaaattaagaaagtacaggacaaggtggctataacctggctagaagtaagatatactgtcatgaaccattaatttggtgtgactatagaatacaatcagaaaaagtaagttgccaatggttattgcaggcaatgtcaactgacaaatgaaagctatgagtgataatatgagtgataatgtctcatctcattaaatgtaacagtggaagcccaataacctaccttgtccttttggaaacactttaacctatattgaaactcacttttacaacgtatggcaaagaaatagaacattcataaaaaacaatgcagtttgcagacaaatttatgaagaagcaaaaaatgcaatgcactgttgacacaaatacatagtttctcaagcttttagttctctacagcttgccttccagatactcagaagcatttttacataatctgtccacatagatactgagttatttgatattgttgttgttagttgtggtcatcaataacaccgtaaatgatgggattcacatcagtttttgttaatggttgagctgagcagcattaatagctctggtaagtccaggtttttaacaatgtttggtgagccttactcaaatgaatagtaaaggtagatacttagcttttcaatattataaacctgctattaacggtcataaataaatgtatgttttggcaacatacatgacaatctgcattgtttaatattatttgttgtggtcagaaccactatatttaagtagggctatcaattaatgtcaaaaggtacacgcacttaaaagatattgaaccctcacgtattttttgtgcaggccaaccttactatttgaacaattgcacaaattgaaaatggaacaagaagttttgaaaagaaaggctgcggcaaaagtggcaagagtgaaacggaaatttattatccaacacaagcatttatcacaacagagtactgaaaacacaggtaccagtttaattaaactgaatatcaatataagttatttaacattgaagtaaccagcttcttaattgtggcagttattatttttaatataatgaatcactctctgactttttcagctcagctatcagatttgactaatgctgcaaatgctagattaaccagaaaacttatactgcaagcaaagaaattaccaacaagtaaccatagtaatggtaacagaattaacaaagtgaaggaaacaacaggtttaagatatgtacactgataggcagaacatctgtgaaatcatttgatttcatacattggtgttattagtgaaacactaatgataaaagattttatttttcaggtgctgttaattcacctggaacaataggtcgggaggtatgtagacagattccattagccgatatcagtaatactcaaccacagtcaactgagctcccaaacaaacgatacaaaactttggagaacacccgttcggtgcgagcgaatttgctcaatcaatttcatgttgcatcttcaacttctactgctaataaccataatcataaccatattcactgtattgtgtccgaacgcagagttgagccagaagagcaaatacttggtaggggtgaaatacttgatggatacttaatattcctttgtaaataaaattattaacaagacatgctcataactgaagtataggaatattatgcactatgcagaacacagtcataattgggttcaaaatgatgatggtgtatcacaagaaagccagaattctgatcagcagattagctcaggtttgtaccaactacaaataagtgttcaaaacatcaattttgacacgaggacgtattaaaccttcatatacattagaaatgttttaatacacatagtcaaaatttaagtatacggctattgcggattatgcagaacacaatcttaattgtgatgatgatgatcatgtgctatccgaagaaaggtataattgtaatgagcaaattagcacaggtctgtaactctattcacagttaaaatagttagacatgaactgtttttggttaaataactgttatggattatgttagactaatgttttatttcttattagaatatcttgatattggagacccaattagtacatgtacgtattgcaaagcttgtatgtggtatcaagaaagtaagacaaagactagaagcaaggctaatgctaaccacagcctttgttgcagcattgggaaggttcaacttcctttgctaaaagatccaccgttactcttaaaacagctactatatgatcacaatgaaccgcaaagcaagaattaccagaaaaatatcagggcttataatatgatgtttgcttttagctctcctggtgccaaaatagataacactttattgaaaggaaaaggtccacctatttatagagttcatggccaatcatgtcatttgattggaagcctattaccaatgcctggaaaacaaccaaagtttgctcaactatatatctacgacactgaaaatgaaatcaataacagaattggtgcaggaaggtaaatatagctattttttaaagtgcataatttgacattttgcaaaattttatctgaactcacagtatgttatcatgtttagatggcaagatactcttgatcgacaacttgtgtcaaagttaaaagatatgttggatgaacacaatgttcttgctaaatcttttaggatggcaaaagacagatttaacatttcacaagcacaaaatctaaatttgactctgatagcagataggaaaaaggatggaagaatttataacctgcctactgtttcagaagtggctgcacttatagttggtgatgcgactcaacctatcaatagagacataatacttgaaaaacaaagtggccgattacaaaggatcaatgagcttcatccatgttatcttgcattgcaatatcctttgctatttccgtatggtgaagatggatatcgtaatgatataaaatatagagttatgaacaattcaaatgaaagaaagagagacaaagtaactatcagacaattgttgtcttttaggctacagtccagaaatggtgaagcccaaaccttattaagatccaaaaggttatttcaacaatttattgttgatggctatacaatgatggaagcagaacgtttattgttcataagaactcatcaaaagcaactacgttgtgataaatacatcaggttgaagacttctcaagaagcccataacaatgtcactaccatttgtgggaagcgtattgttctaccttcatcttttgttggcagtcgtagatacatggatcagttatattttgatggaatggccatatgcagcactgttggctttccagatttgttcctcactttcacttgtaatccatattggcctgagatccaaagagtcctttcacctcttaagttaactgcagctgatcggccagatattgttacaagagtatttaaaatgaagctagaccaactaatgtctgaattgaaagataaaaaaattttaggcaatgttatagcatgtaagttctgcactcctaactcagacagtcctctctattgtaccattgttttgtaaatcagtttaaccatgttaactttcgttgcagatatttacacaattgaattccaaaaaagaggattgccacatgctcatatcttgctatttttagctgctgacagtaagtatccatgtcctgcagatattgataacatcatatcagctgagataccagatgctattgaacaaccacaattgtatgaatgtgtgaagaatcacatgatgcatggtccttgtggccaagctaacagaaactctccatgcatgaaagacggcaaatgcagtagattttttccaaaaaaatggcagcctcaaacaattgttgagcaagatggatatcctgtttatagaaggcgaaatgatggaaaacaaattgtaaaaaatcagatacctttagataacagatatgtagtgccatacaatccaactttgttgttgaaatttcgagctcacctcaacatagaatggtgcaatcagacgacatccatcaagtatttattcaaatacataaataaaggttatgatcgaataactgctgctgttgtacctgtacaaaatcaggatggtacaacagggcaatcggttgatgaagttaaacattatttggatggtaggtatatttctccttgtgaagcttgttggaggatattttcatttcaaattcacaaaagacttcctgctgtagaaaggttgtattttcatttacctggtgaaaatgcaatcatctttgaagatgatgatgacattcaagctttgttgtccaaaccaactgttaaggactcaatgtttacttcttggttacaagctaattcaattttcaatgaaggaaaagagctaacatatgcagaatttgtaagaaaatttacgtatgtcgctaaggaaagacagtggaagccacgaaaaaaaggctataccattggaaggcttaactgggtccctccaagttctggtgaactgttttatcttaggatgttgttgactgtgattaaaggacctaccacttatgaacaaattagaacagtcaatggtcaactttatccatcatttagagaagcttgctttgctatgggcttcttggacgatgacaaggaatatattgaggcattaaaagaagcataccagtggggctgtggacactttctaagaaagttgtttgttaccatgctgatatccaacagtatagagaggccagaacatgtgtggtctcaaacatgggagtatctaattgatggtcttttgcataatcaaagaaaaataacaaacattccaggtaaaaaacagtgaattttacagttctttatactattacagcatgtattgttaaatactttcgttaattatatttttttgcatttagatttacagttgtcagttgaagacatgaaaaatttagcattgctccagattgaacacatgttacagtcaaataagaaatcactaaaggattttccgtgcatgccttttccaagaggtgtagatcatccaaatgttgggaatcgatgtatttatgctgagcttaattttgacaagaatcagttgcgtctggattttgaagcatactttgcaagtttaacaggttaggcaactaaattttagatacaaagctattgacaattacattaatcattccaaatcaaactgcaattaacatttgtagaatgctgtctgatacagatgagcaaaggcaggtttttaattcaatcatgaatgctgtaactagacaggctggtgagttgttttttttatatgggtatggaggcactggcaaaacttttatctggaagacattagcctctgcattgcgttccaaaggacaaattgttttaactgttgcttcaagtggtatagcatcattgttattacctaatggcaaaactgcacattcaaagtttgctattcccgtgcctactttggaaaactccacttgtaatatccaccaaggcagtgaacttgctgaactattaaaggcaacacaattgataatttgggatgaggctcctatggcacacaagttttgctttgaagcattggataaatcaatgaaggacatcatgtctatatctgataccagtaatctaccatttggaggaaaggttgttgtttttggaggtgattttcggcaaatcttacctgttatacctagaggcagcagatcagacattgtgcatgctactattaatgcctcttatctgtgggatgattgcaaagtcttaaaactgacaaagaatatgcgattatatcagaactcagaaatagaaaatgctgaagaaattaaaagcttttctcagtggcttatagatgtgggtgatggaaaattaggcaaaggtgatgatggattttatcaaatagaaataccatctaattttctcattacagacttcaatgaccctattgaatccattgtcaaccatacctacccacagatcaggcagaattataacaatgaagattatctaagcagcagggctatattagcaacaaccattgaggttgtcgatcaattaaataagcatgttttgaacattattccaggtgatgaaataaaatatttaagttctgattccattgacataacagatgctgctgataatgaggcttaccataccattacaccagagtttctacattcgttgaaaacgtctggattacctaatcatagaatcatactaaaaataggcacacctatcatgttgattagaaaccttgatcaagcagaagggttgtgcaatggtacaagacttattgtgtctagaatggctactcatgttattgaagctcgaataatttctggtaaaaacattggcagtttggtgtatgttccacgaatgtcattatcaccatcccagtctccatggccattcaagattataagaagacaattcccaattatagtgtcatttgctatgaccatcaataaatcccaaggccaatcttttgaacgtgttggattgtaccttcctaatccagttttcagccatggccaactttatgttgcattctcaagagtcaaaagcaaaagtggattgaaaatactcattcacgacaaagaaggaaaagcacaaaatataactaccaatgtggttttcaaagaagtttttcaaaatctttggtatgtgctcatgtatatttccttttatacatttgatgtttgattttcagctattacaattaattaatttttccttggatgcagaatgtgtcttctattctattacttatcaccatcctcacctggacttggaacgttagtttataccaattgtgacattgttggtcctggaatgcagcattacacttccactctgtatatcaccaccatcatcaggagattatatcatgttaaattgtacgaacatgaaatgtacacaactattgctatcagctatgtaaattttattatactgcaaaaagtggcttctgtcatacacaattttttgggttaacacttaaatagaatgaactgacagtaagtttatgcctttttaaggacaccagcattacacctaacaggtgagaaagtggctcctgtcatatgtttatggtaactgtctaaacattttctgttcttatcgcagaccatgttaaaaatcaaaatcattcaacactttttcctctcagcaatttcatgtatgacactatttgctagccttttacacaattgttgaatccttgtcacaatgatgataacatctaagctattttttgcacattatgacatgtcctggtgtgaatcataattaagtaactatatataattctgagcacattcaaatgtttaataatcttcttgtcatcaaatgctaaaccttgagcctgctaccatttgcctgaagccctgaaccttatcccaatgcaacatttcggccttactacaccattcttagtggattatttttaccacctattttcctaaatcactctgtctaacaaacacatacctgtagcttcagacagcaaaccaaacccgatgtgaacacatcacaatcttaatataaattctaacctattttttaaaataaattccaagcctagcacaatagttgctatatacttgattcaatttgaaggctacataagttgttctcctcaaagctgtgttgtctcacctaattgattttgccttttttaaaaaatcttttattgagcataagacttaatattttgtaagaaacaccaaatcctttgttttctacatcatatgtgttgggcctttgactctagcaatatgcatacagcaaaacttttagaaaacaccataccgaattgcccaactctctaccatataacttttcattaacatgatcaactttaacagaataaaattcttttacaaattaatatctaataagtttaccaattttgcgatacacatatgaaatcaataatatgaaatttctctcttggactaagggaagaataactctaaaaaataactctacaactattcattcaccaccaaacgtcacaacctttcaccgcacttcacaacagttcacaaaaaccaatagacaaagttagtacctttatatatatttgaccgttaacatcaggacgttgaaacacggaaccaatttattgatatcaagatttaaattgccttttactttcaatcaatttgttcgtaactcaaattttttattgctaagaccctttcgctagacacggttatttgcaaaacagaagttatcaaatggttacaatcaaataaaaggtcatttgcaagcagccatcaggaggacgcttaccaagaagaagacacaaaaacactatctcagactcagtcaatctcatatccaaattcaacagccgttgttatcaacagttaagtatttttcattgtactcctcataacaccatttatcctttcttgtatacaaatgagaaccatattcactatcatgaataaattaaaattttttatgttgttcaacacaattttcatgatttgccttgcagctttgcatatttacttatacatgatattaaaacccatattgtgtctcagacccaagttttctttgttcgttgctaactaagattatgctgtggctatcatttgcttttcatatttcattttaagaataaaattacattttatatcaatttttgtatagtggttctttgtcatgctttttcaatgaaaatctgcaatagcacaggtggataaagattctacccagtatctcattttcatatgctatttatgttggttcattcgtaattttagacaaacttgctaacaaacattaggcatattaatctttactgcaaatggctatatcaaacctcattattttaaaaatatcttaacatatccagtcaaatttttattcgtaaatttacaatcacaatttcatatttctcatatacatttctgttactcaccaatctttgctgcaggatctaccaagtgaaatgtattactttttgcgtgattcaagtttcagacagattacttttgcaagaacaagagcatgcaaagttatattcgatcatcaccgcaaacgtgctaggattggttctggttggaaatctttggttactgatttcaacatcacaccagatatggaattgatcattgagttccctaatcctaatagcaaccgtggatgttggtttctttgttaaacacatcttttgtattcagcttatcttttgatgcttggaaaaagtatgtttctaacaatattttgtttatgtatgtaactaacaaccatctttttaacgatactttgtttatgtatatatttgtttatattttgtgtttactctataataactaagactattatattttataaattttcatatgttcttatacttaacttagtttcacaagaattagctatttcaatacatggatgttaatcttagttttaaaaattctaatattagttttaaaaatagtaacgaatgaaacgctacaattaaatactttcgatttcttaatggagtccttaatttattattagcttatatatttagcaatttatcttttacattttatttttaagtttgcttatacaaaaatccttaatcattaaacattaaaaatattttattcaaatctagcataacatggcggagcgaagcggagccgtcccgtgcgtatgcgcacgggtccaaaacaagttagatgataaaaacagtgggcttggtgaagtggtagagagagaatcgcagatacaggttttgctgctcccatcaaaagggtgaaacagtaaattcaatacttatagcatatttaaaaatatttacttcttaagtgaaatatgtgatatgtggactttcttagaaaaagtaatatgcacatatattcattaattatatagtttgttgcttcttattttcttttatttattttacgcataattactgttttaactccctaatttagggtcttatttttttaatttaaatttcgttttaggctcttgccaagctgagaataatagatcgataatttgtgatgatttttaggttccataatttgatttttaattttaagctaccaaagtttgcattttaaaattatcataatcatgaaaaggattaaaaatggcagttttcaaaattgaaagattaaaaagaaatttagaagactaaaacattttaatccccaagttgagagagtaaaataataatgaagtctttctttgtatatatcatatttcatattatcattataactaaaattaattctcctattttttctctcttatcaaataacataaaatatctatgcatcgttattttaacaaaaatgagcaaaaaataggatgaaatataataagatatagaagttaagtaaaaaggcataacatgattttttgttcagtattaatatgcatttaatgtatccttttatgtttttaatatcaacataatatttaacaagttgtaactaaatatatattttatcttcaaagttcaaaattcaaaaactatctttttctctcaataccagcttaaaatcacatgcgttatactgatattaaatttaaacttcataatgtgtaatttttatattattataaattttaagctatcattttttatatttcattaaaaataattttatattaccaatctattaatcaattaattaatttttttataattaacatagattggtacatttataattaacataattacaatcaataatcaattataagtaacatagattatatataatatattaattaataattataataataatttgataattaaattaatcaactaattatatagtgtttactaatcaattgtatatatgagattatgtaggacagtataataaatattttatatattaataaaatttaattataatctactatatgaattagagtatgtaggacaatataatttaaaaattgaaacaaaaaacactcaaatcaaacaccatcttatcttatttttttcttatggttaattacaaatcattcattttgtcattaccttcattttgatgagttaagttgattgtaattgtaaatatactcaatgttattaaactcatatgaaacttagacaatctaattcataaacaacaataaaggagtagatagagagagagaaaaaaaataaggattttatgttggttcgatcaacgtaacctacactcaaagggagacaaaatatgaaactatataattttgcacaaataacatataaatagtcttatgttatatacaaacacatcaaatcgtaactaaccaaaaatactatcctctcaactaaccctgaagggtcttgaattatacgatcatttaccaaatccaatatatgcttgaacttttgattagaaaacaaagtcttagtcaacatatcaattggattgactgttgtggctatttctttatggaaaacaaattacatacactcacgaaattcactcagcatcataggttgattttttagctaaagtcaatgcactatgaatatctcaacaaaaaatatgtatttacatattcaaacccaaatcatgaataagatcttataatttcatacatttttttttgtgggacaaacaggtattcgagacttcttatttaatactcatctaactctcctcctcccatattagaccatattaggataaaataatatttttaattatgattcaatgtccaaatcgaaaatcaaattccagtgattaacgtatcttcttcaactccttttgttaatgacatatatacttcacttttttggtagacaaagcaagaataagttaaatcattgctctccaactaatagcacatctactatacatgtataaaaactaactgctagcaaaattacaaaattggacatcctatatttgtgacacttggcaaaaattagggacaaaatggtaattggacataaatttactaactgcacccctttttaataagtgcactccagtattcccaaattaaaacttgctaattgcacttcctattttataagtgcactcaaatattttcaaattagaacttgctaattgcatcccctttttgataaaaaaaatctatatttctttcatccctctcgcacgttatctctttaacacatagacaatcgtataaatgaataagaataagtaacattaaaaaacttccttataaattccactctttagatattgtcttttattatccaatattagtatacataaaataattattgaactaaaacatatagttgttgatgtgaaaaaataggttatagaatataaataataacatgtctcaaagattatccttacatcttcattcaaaaacaacagaaatttgtttacactaaaacttaaaaaggaattatttggtcacatggtgtcaatgaaatttttggtcttaaagtagtatatttttctttgtattgcagatttgcatcactcttttaattttggatctaatcactttgttccccaatatacatttttcgatccccatttggcctcaggtaaatcacaacacaattgaataatggtgtccataataaattccacaaaattgtcaattatacatttttaaaaaaaatattttttcaaacaaaaaataaataatgtaaaaaaatcgttaactgataaatcctaattgaaatgtatttgtcaatgtaagaaattgataattgcaccccttcttaataagtgcactccaatatttttcaaattaaaactttctaattgcaccccctttttaataagtgtactccaatattttcaaattaaaacttgcaaattgtttccttttaaatcttaaatactcattatatcattttttcatccctctcacacgttatctctttaacgcgtaggcagtggtattacctgtatacgcagggataatttttctaaattaaaacttgataattgcacatccttttttataaacaaattaatatttccttttaaatcttaaattttaattatattatttctttcatccctctcacacgttatctctttaacgcgtaggtaatggtattacatttgtacatagggtatcgtactagccagttacaaaaatacaaaaatttaagtagaagatcaatgaaatgttcaataaaatgttcaatgaaatgttcaattgttaaatttgatacagaacctctatgaaagtgatcattaacacaaacagaagtgaataaaagtaatccagttgatggttaagtagaagatgaaggttcaaagttaagaaaaggtgtaagacaaatggagagaaatgaaggtattacttgggtaaattgaaagagaagacctaaacaggtggaaagtttagtagcaaaacattaattttgtataaaattttcagttattttctttaatttaagttcataagtgaaagttgcttgctacatattacaattcttgcttagattgaaaattagtatttttgttccaagctaatttttttactttttctatccatcttatatctttatcttatagtgattatatgaattaaaattctaacaagttctcaatcagccatacattagtcatattccactcaaattatttaaattttcaatctttttgaaattgttgtgacccatcaattacatttatagacaatattaacaaaattgtcaagaagtactacattacaaattgatcgtcaagtgtctacaattatattacattatatctatatacctatttttattaaataatctttctttatgacacattcaaaaggaatgctaacaaacacaattgaatataaaagatacatataaataagtattataattttcattagtgtgtttacttataattgtcatatctttatattacacacaacaaatataatttcttatttttattataaattcatcattttcttaatttctaaaatatttatatgtttacttattataaaaataggttttcaatttgaaacgaatcgaaacccagcaaatcgatacatcccgtgcgaacgcacgggttaccgactagttattcataaataatgaagataaaaagcatgtttgggaaactggtgaaagcccctcaaacgtaagttgagtccaatagtattagaggaattaatttacaaacctaggtttgggatctcctagcggagacctaaacatgcacataaaaagttatatttgaaagggttctgaaaaacaattataatgaataacttcctaaaaaagaaaaaaaaaatatataaaataatcacaaatggatgagaaaaataaaatataaaaagaccatactctatttatcttcatttaaagttaatatataaaggaaaactccctacactggtattcaatttgtgttaaaatataatttatcaacaaaagaaatataaacaagtaaaaaataattatctttatttaatcacaattatcctctaattaatatttttcttatctaatcataatttttatgctagtgtaaatgaaaagactccttttttatataaaaaaaaccacttttgggctctgggccttggcccgacttaattggatcttgcactgtataaaacagtgttagttgggttattctaaacgagtgtatggagtgaacaatattttccctcctccaaggtcccaatttttcttaaaccctaaaacactctcactgaagaagctgctgcagaagagaatttccatttttacaaaatgtcgatgtcgaagagttccaagatgcttcagtacatcaactaccgtatgcgtgtcaccattcaggacggtcgccagctcgtaggaaaattcatggccttcgaccgccacatgaacctcgtcctcggcgattgcgaggagttccgcaagcttcctccgcccaagggcaagaagcctgccgaaggcggcgaccgcgaggaccgccgtacgctcggcctcgtcctcctccgcggcgaggaggtcatctccatgaccgtcgagggccctcctccgccggaagagtcccgctccaaggcagtcggcgccgccgctctcgccggccctggtattggccgcgccgccggaagaggtatcccacccgctcccgtcgtccaggctcagccaggccttgccggccctgtccgcggtgtcggcggccctgcccctggcatgatgcagccgcagatctcgcgcccgccgcagctcaacgcacctccggtgtcgtatcccggcggtggaccgcctgtgatgaggcctccagggcagatgccggggcaattcgctcctcctcccatggcgaggggtccgccaccgccgatgccgcctgggcaatttgcaccgccgagacctggtggccctccgccacagttccaagttccgccgcagtatggacagagacccatggggcctcccccacctggacagatggtgagaggacctccggctccccctcgccccggaatgccggctccaccaccacctcgccctggcatgccaccgccacctggcagcggtgttccggtgtttggtcctcctcgccctggcatgcctcctcccccaaaccctccaaatcaacagcaacagtaatgggagagatgattggtaggtttgtatttgttgttttgttcaatcctctgtttatgtgtttgagtgtgtgtttgcagaattgagtgagtcagtgagtgtatgtgtgtgagtgtttgagtgtgcgtttgtaaaattgatttttaagttatttatgtttgattgattttactataatagctagtttgatgtaaaatttagtttaaatttttcaacatcaaagttttaaattgctgctgccatcgcattccttgatattgttggaatttgtggacaagtctgccacaattgtggccatggacatctcaaattaactttgaccttgcgacttaaatttcaaatttattttttatcacctctagtctgacaatgaccaaatttgtatcttttctaaaaccatggttgacaagaggcggaatcaatttgtttaccatccactgagcatccagacacagattctatgttttatgtgtatcttgcactcttcctttttgtgtgagagatagtgatgtctagaaggaaaattaaatggtaaattaggattaagatgagatcatgcattttgtaaggaaaaactaattttgttatcataaatctctcctttgtttttatttgtaagggtgttggagccgggtgggtggctattaataataccaactcaaatttatgtttgggcatgaagcaaattttaacatcaataccttttagtcaagtttctagactcattaggatagctatcgataattcgacatgattgtgacttttgagttgcagagtaaaattatagtatgctgtttgccataaacaattttggaatttacctttttatatactgttttaagagaagatatatatgtatattgtatgtgtttgtatacacatacgttcccacccttttgcctttccatcatgcatcatctttatttgtggccagataagtgctaagctggctttcttggtgttttattgttattctgttggtaaatcatcaaggaaagataactttcctgcaaactagtataagctatttgcaaacgctaaccaaggaaattaaatgctaactgatccaaatggtggtaaggcaaatgtgtaattctttctgttccctttacctttgtaaaggagcatgctttagcatagttgtcaatagtgccaaatagtgttgctatcccgtgctcgcaaagtgttgtggctggagcattttacaaaaattgaatagctctgcagtcagtgttatcaatggtggatggctgaaatccaaatttctgctacataaacatgccattgcaccctatggtgctgccatagtgggcttcccttcacattgttgtctatggtggttggcaaaaaaaaagaaccgccatggcggccttggcgctgccaaaaacccatccttttctgggaacatatccagtatttctcagcattttctgtccagttggccatccccaacatctgcagcctctgctctgctctccatagtttatgatcatccctgagaattatgcggccatttaattccagcgaaatgtgacctttgctgccttgctttgttctgttcatatgttctgtttttcaatccctctaaaacaggtattatcttgtattctaactctcctcaaagtttatcctttaatctttttattctaattggttagaataaaagccatcccgcagttcagctatagtattttcagggtctgcctctcagccaatatttgggattgacaactatgagaactgcctattcttaatgttggcaaactcaagagtctatgtaaaaatcatgttatagtcatatatgagtctattttatagtcttggaacatccattgacttgatattggaactgataagagtttacttcataaaaaaacctatcatagattcatagtatccaaaaataatttaatagcatcaccataataaacattcatagttccgactttttttgccattgccctgaatatatgccccatgcctccaccctagatcagtcctattttcaagagtgttcatcctagtttcggtagctacagtgttgcttgatttgcatcatggtaatggatgagccgtgaactgtatgtttcaaatcaggccaaaaatgacaaaaagtaaattttgttacgtcaaaatactgtgttttgggaaaaatagatgtcacaggacagtagattttcaggctcttggacttgagaatttatacatgtctacccaatgctactcactagactgccttttggcgagaaattacatgactcaagcttgtggactgtcagattccctcatgaactagtgaatttatgcacgtctaataaattcttcttaaaaaaaaaaaacaatgtaactcaactggttttcttgacttgtgagtttgacaaccatttctatcatgttcaaattacttttcactgaatcaatgtatccattactgttgacatcttaattactgtccaatttatatatttattttattttaactaatgatttagcatggttgaggacattgcttctgtaaccagcattttagatgttagtggtctattgtctaaaatatatggtgatgatatggtcttctatttgatctatgaaatatatattttcctattgttttttgtggttattgtctcattgtggtctgtatttgtgtcccatccttgtctcattctatgacttgaattttaactgctctaatattatttagcttcgaaacatcaattttttgcgttccatattaaacttaatatagtagaattatgtaagattcttaacaagggatttatatggcttttctccatcatttcctgtgtattctgtctcacttgtgaaatcttttacctttgtcattgttggactgcattcttttagcacattcactgattatttgaaaattatcgtgattgctcttgattgagactgactgaattctgcttgcatatagtaatagagaacttcaaattattgtggcaggtttcttactgttaatctgaagatatggactccgagcttcttgcacgcaattcaatatccagcttgtacttgggaactgattgtcttgaatcactctcttcttagggattgtttttctgatgtcttgatgagaatgtgtaatgttagaagaacaactttaagtattggagggagttattctactaaaacctgagcattagacatacaagtcggctgtgtagattttcaggtgaaaaatgccggattgcatagacagcgttctgatttgagtgtaggacaagaccccccatatcatttgggttaatattacataattatgactttgctaatgtttctggatcattttattttttattttctgcagttatttgcgctttgtttttcttagtgtgtatataactatatatattgtggagacgcaaatgtaataggaagattaaccaggaactcggtggattattaaaaatcggtgatgttgacattctaacatatctagaagagagaaaaaagagaataaaaaatagatattttggtcttttaagtagtttgtatcgagtaataaatcataaaaaattatcccatccaataccacatttttttttccaaatcaaacaaaccccaagttaattgaattctaactagatattccacacagaaaatatacccctaaattcgcagtattcgttgcaattcctgggttaagaaatttttaaccaaaactatgaggattaaaagcaagacttaaattgcaaataaattaaattatgagcctaacattactatttttttaagtgatagatttatatatattttatgacaattttatgtatgcatatttaattggagccaataaaaatgtaaaatttattatgttgtcaataaattataaatcgccatataattgaaaacggtttatttgtgtgattagtattttaaaagtcataggattttatttgattgactaacgtctatatcaatcaatagtatattaaaattaattacttaaatcctctaaaaaaattaattaattaaaaatacacttataatatacttaaaattttccttgtgttgccaaccaattacagattgccatatcatattatttattataattttcaagtcaataaatattacttgttttaagttatcaatattacttaaaatgctatttagttattaatcaatacaactttttttttacaacaagagtaattaaaatatatttttttattttattttataaatggcgttccaccaagctagtttataattaagcacggcgtgaacggaaaaacaaaaccctttccgatcccatcgctttcttagtttctctccgtcttcaaatctagggttcctgcaattgtagttgccgttaccaccgtgaaccaccgcgaacgccaccaccggaatagttgccgccaatttcaggttcgttctctctctctctctctctctctctctctctcctcgttgtttgtatattgattggacgattgatattcttcgttggtaatgctgtgattgaaagaccgagaaggatagaagtgtgtttcaagaaattgagatgtaagcaaactagaataggataccgagccaaagatgttggaacagagaatgcttgaaaaaccattgatttattgttgcatcgtgttgagaatcaaagtaaagttgttttaatcattgggttcctctgggaatctttgccaattgacgatgaccttcgaccttgaaggatttcaattaacgtgtgagcgaaaaagtgaagttgtttattgtatactaatcaaaactttattcattagctatttaacgtggatgcttgctccaaagtactctgcttcttgttttctaatgctttaagaattttagcttttgttctaatgctgtttttgttgtgttcttttttgctttataacgtaatttcagctgtaaggaaacagtgtgtaggattactgataacgttttgtttgatctgaaatgtgacatccagattcgtgatgggaaaaaatgagtttctcacacctaaagcaattgccaaccgaatcaaagcaaaaggattgcagaagcttcggtggtattgccagatgtgtcagaagcagtgccgagatgagaatgggtttaaatgccattgcatgagtgaagggcaccagcgtcaaatgcagatttttggacaaaacccacacaggatagttgagggctattccgaagagtttgagaccacctttctggagcacatgaagcgcagtcaccgattcagccgtgtggcagccactgtagtttataacgaatacataaacgatagacaccacgttcatatgaactccactcagtgggctacgcttactgagtttgttaagtacttgggtcgaactggcaaatgtaaggttgaggaaacacccaagggatggttcattacatatatagatagagattcagaaacccttttcaaggagaggatgaagaataagagaatcaaggcagatatggtagatgaagaaaagcaagagaaggagatcaggagacagattgaaaaggctgagcaaatgatgcagccgactacttctgaggctgatcagccttctcaggttgagcctccgagggaactgaatatggaagatggaatcaagataggattttctcttgggtcatcatcagctaaacctgtggtcaaggaaaaacatgaggcgtcaagggtggtgtttgatgagggtgatgaagagaaatataatgaaaggaatcccagaaacaatttgaagaggaaagaaagtggaggtggaaaatctgctttggatgaaatgatgagggaagaagagaagaaaaaggaagaaattaatcggaaggattattggttgcatgagggaattgttgtcaagattatgagcaaagtcttggcagagaaggggtactacaagcaaaagggcgttgtccggaaggtaattgacaagtatgttggggaaatagaaatgcttgaaagcaagcatgtgctcagagttgatcaggcagagcttgaaactgtgattccacaagttggggggcgtgtaaaaatagtcaatggtgcatatcgaggatcaattgctaagctgttgggggtggatacagataatttttgtgctaaggtgcagattgagaaaggagcctatgatggcagagtacttaaagctgtggaatatgaggacatttgtaaagtaccctagtgagtttgatggaattaatgactcaatggttctgtttattacatgaattgtagtattcgttcttatgtttctttctctagcgtgtcatctttgtagcacaaatcatatcattatcttatattggatacaattcttggaaatttatatttctgactataattaggcccctaacgtgcaataaaagatggtggctgagaaggctgaaatatcatgttgcaggtgcaattagactacagttttattttgtagttttgtggcgagtaaagttgaattcttattcttgccctttgttttctgtttctttgaaggcttagtcaacaacaatcaagttttgattttaactgggagcctgggtggagtcaactacttgtatgaaatgacgccaatttattttatcataaatcatttttaataaacacaagttgcaggtgtcaaaagttaatctctgcttgccatataatgtttaattgaaatgcgattgaactctctgctcccttgtttgaaaaggctacatttttattaataacagacagaacaatatccaagcacaaggagtgtttaagttttgggacaaaattacttcaattgataaaaaattattccacaccagaacccctgcatcccacagcatataaaaaccacccatatctagtgcgttagagatgatgacattgcgttccataattatcattcaatccaactgtaaatgctcccaaagtcctattgcaatgaaacaccaaattggcacaaaccatatattgagtcagatattatgacatccatattttagtgcacacaaattggcataaacaatgcagcagccaaagttctgctattagtcacatgatgaatttcctacgcaaaggaacattaaaaatagatcgccaccgtacaccatgaatcaccttatgttggctgtgaagataatcagcatgagtagccacggggagcttcctcaaagaatcaagctagctaagaatattgattcatttgcttttctttctttttgttgagcaggagcaggggcattggagcaagagtgattcagagtacacacattggggattatgcaaatcttgcagcatctattaacaaatattatcaagaaaagaaaactttcacataggtggcctaagaaaactagaaaacttttctaaagaatcacaactcaaatctaaatccgcgtggaagtttttattaactaatttgataaagctgcaatatcagtgtcacacttttcgtttattggtaagttaaactgtttcacttgacactagctaaaggttaaaatattacacttcaaaaacaatttgtcacaagcatcacatcgcaggttttaataatttgtattgatcacaaagctgcaatcatcgtttccattttttagtgtctgtttaagtagtttgcttctattctgcattttgacttaatggtctcagttgcttccttcttaatgctcacaacaaatgttaggcttctacagttttgtctcgagtggttaaatttgattatttgaatttggaagcacagatatttataccataaaacaagccacgttccagtatttacccctctagaacataaaggctttgatctttggaaatgaaaatatggttatgaatttctttctattctattattattattattattattatttactacttactagctagtgtttggttgttttagaatttttgatagaattgattttgaattgttaaacaagtatatctaaattaaagtacttttatactgttattttatcacaaatcattaggatgagtttattgatttttactataactatcttgaaagtcgtgcttagccattaaaatgattatctttagttacagattttatattaaaactcatgtaacgtgtgagatagatttgtagtgacaatcaaataagcacttactctatgtcagcagtgtattctgtgatattctgttcaatgcatataggtatatagaattgcacagcttcgatgtctttgtactctgctttatttcttgtcttagttactctatactttggccattcattcagagaacaactttcacccaaaaaaaattcagagaaaaactgttcagaattcaaacctgtagccacggacaggcacagaggggttatcttgtttgtaaaattttccatatatatagtacgaattgtttctgcacgaatgagacaaccaggtgggagatattttcattggtttttaataaaataaaggaaaataataattatggagaataaaacatgatattaattaagaaagagtatgcttgtatttttgttttaaagtaaaaaaaaaaacctactaattttatttattgttatttattttaaaattttcatagtaaactatgtaattatatttaaggtccataattttttaatgaaaacaaaaagaaattaaacatacactatataaatgataaaaataatttctttaactaataaactgatatttaatttataacttacttagtattaaagtgacacgcaataaaaaatcatcttctattacattttttttcattttatattatattattttaatttttatgggtaattataaatttttgtaaggttttaaaaataaatattaaataataatgataataataaaacaatgccaatcaagggtacctaaaattctaaaaaagaagtactacagactacagtagtctcaaactgatattttgggtccaggtgctatggtggcatctgactgacattatcttcagttcactaagatatttagatttaatgggccccactaatgtgattttcttaaaaatatcttccattcagttgtgactccctctgcttatattttgatactctgatgctggtgccatcctgcattatctttttagctcaaatttttgtgaagcatttttattggtagaaatggagagtgagcccgtgaagcgcagaattcacatgattgctgctcactttgcacccaatgatgatatttcaactaccaacgttctgcctatggtaacatattatgttcttttacttatttgttcatggctggttcatggttcactagataatgatggaaaataaaggaattcatttgaattcagttatgtttttctcgacacatgggaattatttgggagttagatatagctaagtggggaaattgaacttatgtttctcatcttgtgctaactggcccttgttctccttttcatgtgaacagaaaaaaccatctaataggaatcttcatttattgtcatcgtaggacaatcaaactgcatataatttgagtattgtataaagtggactagcacttcattttttagtggctaaaggatgaaagtagctcgactgctcattggttttgaatacgagaaaatatgccctttcatctcatacagctagctttgaataaattgggaaatatcacctattcagtgtctgattttctatatatagtttaaccccgttgatattgcatatttgcgttaaattaggagacgtattagcttgtacagttgatgtcactatttattatgctaaagtgtttattgatcttgatgttcagcattggaaatttaattgtttaagttgcccttttcttttatgattggcttaggcaataataacttgaacactcttatcaaatcaatgcatttttgtaggctacaagcaacttcaaagtttttaaacttaagtgtttccttcatctttgtccctttttgatatttaaaagtgtttccgtaattcagaatttccatgtgctacacctttattatatgtttttagtagaccattaatttggttttatagcttttgttttacaatgtctaataaattaatctgtacgtactatcctttttttttcttgaatatttgtttgtaattcattttgttcatcaattttcctaccgctatcagaactgcagtggcagtctgaactctgtactccggagatgtgataataaggtgtattttgcacgccaagcttcttcttctcttggttattttatgaggcagacttcaattgaagaggtacttaagtgttcttattattgaaatacttaacagtgttcgatttactttttttgggtaagtgattcatttctcactggcttatttaatacaaatacactaactttcagggtggctcaacttcctttattgctcctaaaacaaatcatggtgctactgcatctgattgtctttctaatgcaagagcaccatgttttgctagacctgcaagggcagaatcagttttcacaaattcagtggtccaaccaatggctcaggagcagggctgtgattttagtacacttgatcctcctacatttgctaggccaaccagacagattagaggagatcagttacattctgaaaagaaaacgtgctattctgaaattggtggttagaactttgaactcggaaaggcatttgaagtaataatagttgaatagctataagaaacagatcgaagtatattattttgagtttaatttatatgcattgttagtgtaaatttttttatattgtcaacatataagaaataattattaatttgatttttaaggtaatattgtaaaagttaacaaatcacttgtgattgaacgaacatgaaaaaaccaatcacaaaccagtgcatagactatgtactctgtaatttttgtgacctttgttttttgcaggaattgagtggtctccaaggatggatgttgcagaatcagaaggcaaatatgttatcacagtggaagttccaggtgtcagtatcagtgacataagagtggaggttgatgaacaaaagtaagaagaatctctaatatacacccgcatattaattgtaatactctttgcaatttgtggtattaagcatttagttctccctaatcaatagaaaagggagtggtgaaggaaaagataaggcaaaacaaaatattgttggatgctctacttttgtctatgtcattattgtgtttgagtttttctttcatttgtgtaccgggggagggtcttgtctattaatacaaactttatacattatttctgcattgtaatataaagcataaattctggaagtgaaacgctaaatgtaaattttaatgttggacattcgtgatcatagagctttcgtagtataggacctcctttctttgtgataaaagagccaatgtgtgaactgtgacaggttgtgtgttaaaggtagacgctctactagcttttggacagttgcaggttgtccaaatgcttccttttcttcatatcatcggagggaaatactatatggaccatatggggtggtctggccacttcctgcgggtgtgaacaaggacagaatatcagctgaatttttgtaagttatatcttagtgttatgcacgtgtctcttgattatagcctcatattttaactccattctcaaactatatatatatatatatatatatatatatatatatatatataaaacctcatctaatttggtctattgcattatttaattttttagtaactttggtttctggctcagtcagaggactctcaaatgattatattactaacaaagttcaaactggaagtagtaataaaatacctaggtacctaacatacattaggaagattttggctgcaagcgatcacactgctaagccaacaataccaggctagtcattagtgatctcttttactaacacaaaatggagagtcaaattgtaaccttgaagttcaattgagttcactgagaaatttattggatatttaatgttctgttaggctaaaatagctgattcactattgctgcaactagctactgtaatgatggccatcacttttatactgttttggtacttagatcattatggtattttaaatacaaaaaaaaaaaaaaaaaaaaaaaaaactgaatctatgccaatcctaatgctttgtttggcagctagaatactgccatgatgattcataaattttcaactcaatgtaaaagctatataatttatcacatctactcaaggggaactctttcccctacctctctcctctattctgctctgctgaaaactgaaaagttttccccatatagcttaaaataagtgtactttttttgttttgttttggtttactgaatttgtatgtgacttcatatcattttattttaaaaaatatgcatgcatggggtcgaaagtgacttgaataatttcagggactagtatgtgatgtgtgtggttttgcacaagttcaaagatatgtgctgtacctataaacatttgaagctgataatttgttgtttctttccccattttcagggatggatttctacaaattatagttcctaaagtttgagtatgactgagcaatattgatttgtagcacatatatgtatacgtatacctataccccgtgcatatagatggagaagaaatgggcattgttctgcatgagccatgtcatgccgtatatatatttgtaatgtaatgagcagatgatgggttaattttgatttcatatacaacttaattgttgtgcagaaaatgtcctgatgcatcgtgagatgttcattctacgttccacttttgaaatctaatttattaagtcattaatacaccataccgtacaaaatgatacatagaacattgagggatgaatctctgtaggagatgattaaactaatcacatggttgaagtcgacttccaagtatcaatcatatttgataatttcaaacaggtctctatgctctcatgcttctatctgaaagggggtatgattctgaaactcacaaagttagtatttattatttatataaaagaaaaaagaaagtgttgaaaatatctaattaagagaatgatgaattttagtttataatataaataagaataaattcttctataatttgatgtcggtgtcactgccatagccaatgacaatatttattccttcaacgttcaaagtgggagagagcaattgcaacagcaccgatcatgcttattgctcactatttaggatgatgattaggtttagtttagtaggatcatgtagtctttattcatcagatttctttatttttaattaaaattacattgtagtgtttctcataatattatatcatccaaaattgtttaatgggtaacaattttataattattagtcgagataacttagataagtgatgtctcatttgatatcatgtgatggtccaacctattatagacacactcacatcataaattcaaattaaacaaccaatattcacaaactaaaataacaatgtataaatattttcttcataaatttatataaatgataaaaaaattaatccaataattaaaaattaacaatccactaaattgttaattgtgaaaagaagggtcgataaaaagggtaaaattaatcctaaacctaaagtgcaaaaaatcatcatcaatttcatattattaactgtagaacgttaactttaacgtaacgtcccacttcaaataatctttgaatctttaatgttaacatgatcttcaaaaattataatttaatattaaaataatccttaaacattataacttaataatatcagtccacaaaatagatatataaattaaaattaatgttctacacaacaatatgatattttttacacactttttttatattttcatgaactatttcaaaaaaattgtttttccaggaattaaattatcacccccttatattttaagggactatagtggttacccgtcctttaaaaaagaagatgtaagggaaaggtagggtattatagtttagtatatttcaaagaaaataagttctgatcttaaataaaagagatgtgaaaataacatgggccatgagaattctaaattaccttattgggcctcgacttataaaccaggtccataacatattgtaaacgacattctcgcagcttcgtctgcaaatgaactataactttacaatccgtcaatttacatcctctgtaaagtattaacaatttttttttatcccattattaatacgaaatatctattaattttatagataattaatctacgttaaaaaatttgatcaatcatcttttagtgaattttttttctctcaatcatatttttttattcataaaactcaaatccaaaatcttacttaaaataacataattcaaattcagtgtcatttgaactattggataaagaaaatcttataaccattgttctgcatttatgcttaaacgagaaagtggatggatgaggagttcttttttttcccattttttttattgatgagctctatccataatttaaaaccaatatgttagcttagattaattaaaatattatcactcaaacaataatcatcatactcaataagttggatcaggcctgccaaattgattagaaatgaattgactcgcttatcctatattttatataacattacttatttaaaaaaacaaaataaaataaaattagtactgctgataaaaaaaaatttcattaataatgcataaacataaactattgtgtctttttaatttcaccatttcaattaactttaatttaatattatatttaggggtgttcgcaggtcggtttggatcgattttgatcaaatttaggacccaacctaatcaaatttgatcggttcggttttagaaaaaaaattgaaacacaacccaacccgttcatgatcggttcgattcggttcaatgggttacccattttaatttattttcttagaactactattttatatcatgattctttcaaatattcaatacaattaacacaatattatcaaatgtatgaaagtagtaaattgattcatttaataccatcaacataatattctaaaatagacttataatataaattaaaacaaaagattcttgaacaagatttaatataatagtctgattcacaactatttcttacaaattgagctttgctataaccaaaattgttgtaaccagatttgctgaaacaaacaaatgaacagaaaatgattcattaatattataaacacgataaacaaaatatgaaaaaaaggtgaaacaaataacaatatacttgaaagtaatacattaagaagtttcaacacttgcagtttcaacacttggagacccaatattagcagtatttgaagtcaaaccaaacaactctaaaaatttaaacacaaccccgttagcacaaaaaataattgatatttatacaaatataaaaaatgaaataagagattacacacttgaatcaatcttttccgcttcatttatttcaatttgcaagtcattaacattttgcttagtaaatctaagccaattttggacacaaataagagcttcaacagtagtaggactcaaggaactacgaaatgagtccagaattctatcccctgtactaaatgcagacttagatgatacagtatatacaagaatgaccaatatatctctagtcatataggaaaaaatataatatttggatgtcttcaatttccaccaattcaaaatgtcaaactcagggtggtcatcttcaacatcatcctccaaatacctatctattttggacatccttccccttcactagatatgagatttaacacatatgaagcttcaacatactcatagagataaaatgcatgttgcagcaacatctaacatcaaataagttgagttccactagttggtacatcaagtattaacatggccttagtggatatacttacttcttcagcacaccttttaaaacttgcaaatctacttggagaagacttcacaaacttacatgcaactcttatttttttaatggataggtcaatttctttcaatccatcactaataattaaattcaaatgagcagaacatcgcatgtacatgaactcaagtattttattagaagtgaaaagttgggcttaatattatttattttaaaataaccaaaatataagtatactatttatctattaaaaatttgttgtgctacattactactgcctaaaattattcataattttgtccgaatttagtaacaaataaaatgttgtttctattaatttttttggcaaaagaaacaaattaattgggtcatatgctaaactatgggaaaaaaataatttttaattttaatatatatatatatatatatatatataatttatattattatttacaggttcacggattgggttaacgagtcaacggatctataaatctaaatccgtaacacaatccctacattatcgattttgatcggttcggttcgattttgacccaaatacataaatgacccaacccaaatagtttagatcagttcgggttcacggatgacccgtacctgtaaacatcgcatatcctttttttaaaatatatattaaacataaatcaaaaatcttttttttccattcattctaattatatatagcgctacctcgtagttttatgcatcggtataacagaaaacagcaatatatatatatatatatgtgtgtgtgtgtgtgtgtatgtgtgtgtgttttttgaaatttaacttaaatgttacagcccagccattcattattggtcatgactggcttcctgtaacaagcaaatataattaatgttaaataccagtacgacttctagaaatgataaatgacgaaacgataataattcattttaattagtattataaaaacaaaaattcgaaatagcgcgtacccaatgaatccacaagaaatttagagctcgaagtagcagtttaataatttaggtcaaaagaagaagcatggtagtagttagtagagtccaaaatggaatgctgcatttgcagtactaccaagttaagctagctggcatagcagtgtacgtagtggcagtcaacttcatgcactctctctcgataacaaacacactttatttagattactgcacgtacgtatgaatacgaaaaatatcaatctccaattcaataatgcagccaaggtcacaacattaagtagattagtgctgcccataatttttttttaaatcgaaccaaatcactctattaaaatggtttattttgaacaaaattgttttcatcataaagtggctagtttaactttaacttggttcggtgtttagtttagttttttcttttcctcatacgtatcaagtttttttaaagaactaaactgaattactttataaaaatagttttggttcaaacttatagatcatttttataaagtgattcatattcaattcttctcaaaattataatttggaatggtcgagttagaattgatattcttttcactcacagggtacgtacgtgagacttcattgagcattaaacattcagtagcctctttcttttgtattttattccttaaattaaaacgcgttctattctatttattttctgcctctttcttttgtatgtccccacacgctatctccctttcctccttaattccaaatttccaatgcaagacgacacaaaaatgttactttcttcttcccttggtccgaactccgaatcattatccttctggtagctgttgagagttatatgcaagtcattattactttatcaagaatcacaagtaggacattggaaaagaaacagtgcggattctgaatatttttgtagctgttgctgatagagagagtcctcgcgcggtgttgacaacccttcgaacgttgagacataggaatgtctctacttaacatcaaatgcaagcaaacgaaggtggtcttcaactccttttcatacctataaattaaaggtaacatttcaagcttcaaaccctggtcaaccactattagctagctataaatccatgatactactactagtattgcaatagctagtaaaaaaaaaacaccatattaaattttacctttcaggtagacttttatacgtatgtgtgggaggggagttaggggtcaggctacaagtcatcggcaaatttaaaataattcaaatcaattcaaacaatttaaattagatattttttgtgtttgggtcaaatccaatctaactcattcaagttcattgaattttggattgaattataagtgtaatatctagatccgcttatttgttgatccaacctattgacccgttaatttatattaagttgttattatatatatatataatatttttaaattttaaataatcaattactattattataaaacttatagtaattaagagtgagattatttttctcagttctcatgatttcactcaagcactctcacaaaattaggatttcaactcctagctgctgatagaacatctattttgctttttttttatttgttttaaactattttagatttagttgaaatttcaattatactactcatggtttgataatttgataacattgaaattttcaaactatactgtaataattttagttattgaatttttaggctttgtgagtgtgttttttaaacttgtttattatatttcaatttgtatatcatatttaatataatatattagcatatgtgatgatgagacaatgtgattcctctctttatcttttcttccattatttaactataagtaataattataagtaaaatatttggtatttcatttaataaagattttagcttttaaaaatattagattttaaaaaataatagacaaatttaaataatttgacctgttgacccaagtcaaaccatttataaatggattagtttggattgagttttattctttttcttgaaaaattgacttaaatcaatccgttcaaatttaattaaattgaataacaaatttcgtcaaactcaacccaaaccaacccgtatacaccctaaggggagggttggttaagtttaatttaaatatttcttttaatttataattttaaccatttatatcactttcactcataaaaaaaacatttaatccacatgcgtatcccatcccatttattttaacgatgtcctttgttaagcataatttactatctgtatttaaacattctttgatgtttggaaacttaaaaagttaaaataaaactataaacaattaacaaagattggtctaattgataagaaataatttcatatcacaaaaagacgtgtggatttgattttcattcttcgtataaaaatcttgttgttgatgaataatttgtaaataactctataaatgttcttaggacttatttaacattaatgagaaatccaacttacctaaacttttcaatagaaaaaaaaacacttcagataataaaactatatttatctttataaatacttttgcactttttttacaggaaaaaaaatacttttgcacttgtcaattaattatttaaaaacttaaatattaataccttatgatgtttattgtaaagtaataatctcctcaggagtctcaatccagcaatgataaagctaggttgggaaaatgccaatacttggcagttatggttccattaggtcaaattaactgctcaatattttcttaattgtaattaattttcatttgtttctatagattctcaaattaagagtattgctacttcataaaatagaaaataaaaaatcgatataattttttttactggaaaaatcgatttaattcaaattataaaatattggtttaacttaaattaaatttaatatttttcaaccgaattaaacttaaataaagtttttgatgattaatttaaataattttttacctcgcagttgcttaagacttgaacttcccctcccaccgagccgaaagatgtttggagcatggactttgaccacatcgaaatggctgaattacggttgcaatgataaagaaactatgtgattgccaaaataaaaaatatataaagaaattcttcttcttttaatcaatttttataatatagagataaataatacattttagaacaaaaagattttgggattatgatttttttaatatgattatcatacagtatcttagaatttgaatgtattggacaaaaaatgtgaaatgtctcctttttttttatatttcttcaagtgttctaatttatagttccttgggagcagaaaattgttaatcatgcatgtcttggtcatataaggcttgcattaaatgtttggaaacgtttagacacatccttttatattagcaagttgttttttttttttttttttaataacaaacaacttttttccctttattcttgcattcatagcattgcaatgttccctaaaaaaaggataaatactatatgtttttcatcctttcaaagtagtagaagttcaattttcatttttttaaaatatattgtcttattttagttcctaaaaatttaaaacgtattaatttttgttcaaacatctaatattagtggattgttgttgtgactaataaagttccatattaatattgtattagaacatttttaataagaatttatagaagaatcttttaagtaaaaaatttgtttcttattatagtttcttttcattggaacaattttactcaataagaagagtttatataaaataagatttgtatcttatgcaagaaattatttcttaataataaaaataatatttatctacacataacaatactataattaaattataattaagtggaaaaaatataaaaatgtgaattttttgaaaatttttaaaatttcttaccattaaaataaatttgtatatgaatttcttaagatgacatgacattataataaaaacaaaaaaaaatactataaaaatcataaaaaataacttaaaaaactcacttaaatttttttcatcaaaaatgtcgtcagtgaacattttgaatgaatatctgtcatgtgtcattcacttcggtacatgattatcacatatgacaagataattttttttctcccttaaaaaattaaatttgattttaattactataaaatttataagtttgggtttttgtcctcataaaatattatatttttattttataagtttgatttttagtcctcataaaatattgtatttttattttaatataatatattatattaagaaaaaaacaacataatattcataactttgttaggaatgaccatggatgggttgcgacagatatatttttgattctacgcatctcaaaactttgttaaggttatttatgtaagtttaaacccctcgattaaaacccaataatagatgggacaagatggacgaggtcaacttgatttattaatgtaatatattactttttcaattcttagttataaaatcattttaattaatttatattttttaagaaaatgattaatttaattaattacattaaatctggtaattcattacagtatcattataaaattataattttcttatctctaattatttaattattttcattaatattttaagagagaataattaaggatatgtaaaaaaaattaatgaatctaaaaattagaaaatagttttataaaaaaagacaaataaatttctgaaaagtatcttataattagaaatgaaggaagtaatattaacattattaactattagaagaaaatggatacttcgtatttaactatttttctatgttttttaaaataaaaagaaagataataaaaattaatggatgatttgtgaaaatagttataggaataaaataataatttatgaatgttagtgataaagatataatacaattatatagattaacgaaagatttgtgtagaaaaaaagttgttattaatttgttggctcaactgctcaagagctagttttgggtcaaaattgcttccagtgccgctgtcaccgtaactcttcttttaggataaaaaaaaaaattattgagttatgaatattatgttattttttaatattacttaatatattatattaaaaataaaaatataatattttacatttttatgagcattaaaatcaactttttaatttttatgaggacctaaaattaagcttttgaattttatgatgaccaaaattaaacgttatattttgtagaaactaaaatcaatttttaaatttaggacaaatatgatatttttctcataaaattaaaaaatattcgaatttcgttcctctaaaatttttagtaagttttttttctttacaaaattaaaatatgttaaatttggactagagctaggttgagatatattcaattaaaatattaaataaaaaatcaacagcataagtctttatgtatttagccataaggataacaaagatacgtgaatcatgaatagatgcaaacctatgtagtgcgtttaacacttccaaattaaattaacagatccaattattctaatgttgaattctgatggtcaattctacatagatcaaataccgtgcttttctttcaattgaagataaacgttggatgcaatgcaatgcaatacgacgctcgatggagttgtgaaaattgaaaaaagaaaacaaaatgttatctagtctcatcatttcgagctatgttgctcatttcttaattattacacatttgaaaattacaaccaaaggagtctaattggttatacaaaatatatgaattgttataaattctcagtatctttgattcttatgaatttttttataatttttgtgaatgatttactctgttttaattcttatccacacaaatgtaaatcacaaaaataaatttttagttacttttaaattgtaagaaagtagaagttatactactataacaggagacttgatttaattttaaatattctcaatctaaatttttggagtttttctttcttcttttttaaccctgggaaggcaagcgatatcaagatatggccacaacgcaaccaatccgaattctataattaatgtttgaatacacatttcccacatccaactttgagctttttccttagcgtctcaaacgcacgtttcccacgcgataggattgcaaacccccttcttccttgtaactttttttggtttatgcttgaagtaataaaattgggtaagatggtttgtgcttaaagctagtagtaaaattgatttgggtggtctacccttaaagtaataaaattgggtggggggtaaattacatttaaaactattagcagaaactcaccagaaaattattactatataagtctaaaccacaaacaatttaattgattcattcaagactattcaactacttctacattaagagatctgttttaggaaggttgttaatcaagatataagaggcattaacccctcatcagaaggatcagaattaactctggatcctttaccaagttgtcttccatcaagttgcaactgagcattttacagatattttcacaacaaaaaaaaaaataatgcaatgcacaatataaatactcatattgggtttggcatagttttttgttttttttgtcacatgctcccaaccagagtacaaaagctactaacatcaccacttatgcaacccagtgtctatcctcatctgatagcatataatagtctctgactcactccctatcattttcttccagcttgaaccaccaaagagtgaaaacactttcatggagaccaacttagattattccaagatgctctttttactcctccttggttccacttcattgattttcctctcacacttggcttctgcagccactcccaagctcaacactcaagagtgtaaaactcattccttcactcattgctgttcacacactttttatacttgtatcaaatcagttcatacttcataacattagtttataatcctttctgctttcccatgttttggatcggaacatagagttgcaaaagtgaggtagagtagtcaaaagtggttttgtctctctcatttcttttgtttggatctatggacagcaaaagaaaatcatagattggttgtttcatttcatcatagcttctaattctataattctatgcatatgcatctgtggtaccgtaagactcatttgaatgttgtttgctttttctctgatcgatgaagttgagttggttgaattgtgtgcagtgaaggcattgaaggaaataggaagcaagattgggaagaaagactgggactttggggtggatccttgcagtggaaaagggaattggaatgtgtctaatgctaggaaaggctttgagagttctgtgatatgtgattgttccttcaatcacaattcttcttgccatgttgtaagcatgtaatgctctttctctctctcttaatttgtttcaatcaagtttttggtattctttgtgttttcgagaactcagattatggacgataatcacatggaatcacatgtgcacttaggaaaatgaagatgattttcttcaagttttgattaattaattaatcttcacggccatattgcttcaactattttttatttattactacagacagcacctaaagttaccatcaaaccttcacgtgcaattacatattttttttaagagaaaaaaattgttcagttataaattcgtgttttcatagctggattccaagaacctttttaattgaagctaaaaggaagaaaagggtaatgggtgtttttctactaattttctttttacctagaatatttccaaagatttatgcatatcctgcattcttcaaaaaattgaccatcgcgaatcttaatcatgcacatttgtggttgtgactcgtcaaagtaacgcgtagcactaaatgagaagaggaaaatgtttctttttttttttttggtgaagagaggaaaatgtttcttggactatatttttaaaataaatgtataccagaaaaataaaaaataaaaataagtgacaattttttttttttgagagagacaaaattaattatatacttatcatgtataatgttgatttcattatgtttaagtaccagaactcattaacatacaaaaaattaagtttgaaatgtcggacacgggtctcaatcgacaactcaaccgacctgatgcaagttgcaaatcgttgactttgaaaaggatgtgctgtctttatctttttttctcgtcaaaattttcttaaattttttaattttcatctgttgggctatacgttcatgtttttgcttcaaactatttttttttttttttgttacgtcgaactttgtctagtaaaaagtaatttgttgatttttttaaataggaaatgttgattaatttatgttcaaagaatgggaaagggtttactgaacactagatcaactgttgagtgttgatggttaccacagaaggggtactaatcactagtctcagagacaggtcaatgaccaaaaatatgtagtattatttttcatagataacacaattagtttttagataattattacgaaagtcagcaattttgacattcataacaattcatgattgtttgatactgtaagatactttaatattgtcaatcaaggtcgaagatcgtggatagtacaaggaaattaaaatattaccttaggtcttttaattttattttacttattattatgtaagtttttatataaatctgtttttattgttcaaattacaatgaacaatgatgttttataaaaagttagttagctacttgtcttaagtaacaattagaggtgaaaaaaaaaaatcaaaattatatatataattaaaaattgaatttgtagtttattataagcaattataccattaattaggaacatggttattaatgttagagatagaaaaatttaatagcattaagggctaaagatattaatgcatgattatcaatttctttaattaaaaataacatttattcaacattctcattgtttctttatctctttttcatattttttaataccttaattgatatcagatttttttttataaaaaaattgtttatattatttagtactttttattcttatattttgtagtaatagaaaaaaatcaaatagaaagtagtaacttggttttcaaaagttaaaataaaaataagttaaaaaaaatctcaatatataatactcttataaatgtcttactattcataaaaagaatatataaacatgagtttaattggtaaaaaaaagtcacaaaaaactaaaaaaattattttaagaaataatttatataatattaagtttctttaaaaatttgactaatgccctaaaatcctaaacacggtcctgctgtcaatacattctaattaaattcttgaattaattctaaattctactttggttaattttttagatttaatctttttgtgaggacttcctaacttttgtacacaagggactcacaagattgtttcttttctcatttcatgtactgtatttgtttattgattggatatcttggaataatcatgttaaccaccatataattataaattctgaatttctgctttttatttcatattctaaatgaacagattcttgaaggctcagaatctgtctggtattctctcaccagagttttccaagcttcatcatctccaagaattgtaagatatcaaatctcagttttgaaaccatgacttttttttgctctgcatgatgttccctatggaatggtgaagtccactaactttgtcttgcactttcaaacagagaccttagtcgtaacatcatcactggttctatacctccacaatggggtaccatgcgcttggttgatctgtaagaactttctgctttgcaccctttggtttctctgcattgtctcttcaatttcttctgtatacagtaaacaacttgagagtgacactaaagattcttgtgaattgaatgtgcagctcttttatgggaaacaaattgtcagggccattccccaaagttctcaccaatatcacaaccctcagaaacttgtatgttgaaatcatttctttattttcaaatgaattgtatgtttactccatcacttagcttagtgataaattggatgtatttttaaagaaaaatagaaagtaaaaaaaagaagtgaaagatatatttggaatatctaaaggtagcttttaccttttgccaatatatttgcttttacctaaaggaagcttggcataggtgatccaggattgttggtttagtataatttccaatttatttctgcagctttgtttaaattaaatatttgtatgaatgttacaggagtattgaaggaaatcaattttcagggcacattccaacagagattgggaagttgaccaatttagaaaaactgtaattcttttgatcttctttgtgtgcttattggaaatttggaatctcaatatctgcttctattttccccctcacatattattctgtagtgttttaacatgagtaaatcatgtttgtttagcattctgtcatccaatggattcacaggagcattgccacccgtgctttccaagttaaccaagttgattgatttgtaagttcttatcaatttaacatattctagcacatggttacaatctgacagttaaagatacacaaagatgagccactttgattctatttaatattaggtagtgaggtgttaatgcaagtcactgcaggtttcttaatcaattcatataaggagctacaaaattaaagaatctgtagctttgtttatcacttttgttcttttattgttgttacatttaaattttgacatttccttgcatactgattaacctttgggaaacacattttaggaggataagtgacaataatttccttgggaagattcctgatttcattagtaactggacattgattgaaaagctgtaagtttcctacctcgttcattcttgttgtatttgttgtatagactactttatcatgttaacttttttcttttggggttacaggcatatgcacggttgctctcttgaaggtcccataccttctagcatttctgccttgacaagattaagtgatttgtatgtttgtaattctttattttatttatgttttggtcatagaagatgaatatgttaagtgattgttttatttattctttgatacttaggaggataactgacctaaaagctagtaaaagctcagctttcccaccactaaataacttgaaatccatgaagacactgtaagttcaatgacttaaatgcttctttctcttgaagtctttataaaattgacctatattttatttggacatcataatgcagggtattgagaaaatgcatgattaaaggagaaatcccagaatatattgggagaatggaaaaactgaaaattttgtaagttgttcaacaagtaacttacaacagttttgacaacatgatatattactttgaggatcattttccacttgagaagatctcatagaatcaattcaaagttggctaagccttcttttcatataaattataatattgacactacgctcataataatgttctataattttatctagatctgaaatataatttttttccaggtacaaggttttgtaggtcagttatggtattattttgtttatagccgtgaaacatgggtaattactaactagcactaaacttcattaagagagaagcaaaaatgaaacagatatgtctatagtctttccggtgtagattgatttttcaaagttgaatggttgttgctctgatgattcatgtgtcccttatgaacttctatcatagaccttgctttacatgaacaccatatcactttgtttgaataatactgaaggaagattataaagacagctataaaatgtagaacatgctcatcttaaagttgaagataaaatacattttttataatataaaattattaaccctttcgttacataaaacaagttcatttatttatcttcgttgctgtagagatttgagttacaatggcttgagtggagagatacctgaatcttttgcccaacttgacaaagtagacttcatgtaagtggatgcgttgaataaaatatgttattgatacatttcatttttaattttgacgaaacaaaatgtattaaataatgcaggtatcttaccgggaacaaattatcagggaaatacctcgatgggtcctcgcaaataacaaaaatatgtacgttaaatacttgaattgttatgtttcaattttcagtcttcatcttaatatttgcttcagtggctacagcgaataaggcagtgaaatatatgacaaaaaatataatataatataataacaatagagtttaaaaaataattttcaataatattaaattttacaattttaaaagttgtatataatgaatatttaaaaaaaaaaaaaaaaaaagaccgggtcatgtgagttaattcatgactcacttatttaatcattgatccaatatcttgactggatcgatcaccggtttggtctttaaaattatgctctctgggatcttcaagccgttgatgtctgcatctgaaattaaataagcactcctttagcaacatgagattaacatcttttattatatattttggtgcacagtgatatctctgacaataaattctcctgggacagctcaagtccaactgaatgtcaacgcgggagcatgtaaagttttagtttatttaagctttgagtaaaagttgtcttcaattagttatcagttatcactgcaacatttttttttttttttccagaaaccttgttgagagctactcttcatctgtaaatacacagtaagctgttgtctttggaatattttctgtaaaatttggttattggtagtagccctagaatataaccttaaatttctctcttggttgcagaaataagattcattcatgcttaaaaaggaactttccatgccctgcttcagttagccaatgtaagtatgtgaccatactacaacttttaaattacttttatgatctgatgggctggtttaaatattgactcaaattctgtgacctgaaattgagtgaaataagttgatgagaaactttcaactcaacatgatttcataccaaaagaaaaatttaagatagtcatataacatgattttgcttatgattctatttacgcaaaagttcactgcctacttctttgctaacaatcttaagcccagagttgtacagaaattcaaataaaacaaaataatgtaagaaggaataaatgtccattaggagagaaacaagaatataactgtttttcttaaggggttaagactaatttcctccttttctaattatttgaaataaataggttgactaattctaagaaacttaaactggaagataatttgatatccttttttattaccaccattgaatgattgtaatgacattttattcttttttattacaaccattgaatatgttacattctttgcgaattttacctttctatgcagttgtctatttttaccattagaccattacaatttgaaagattttacactgagtattctttcttttcaaccctgtttgtcattgttttttcaatagatcagtactccctgaacattaattgtggtggaaacgaagcaaatattagtggtaatatttatgaagctgacagagaacaaaagggtgctgcaatgttatattacactagccaggattgggctcttagtagcactggaaacttcatggacaatgatattgactctgatccatatattgtggccaatacttctagacttaatgtctctgcactcaattcacaactatacacaacagcacgtgtttctccccttgctctcacatactatggcctctgcctaataaatggaaattacacagttaagcttcactttgcagagattattttcatcaatgataggtcccttaacagtcttggaaggcgagtatttgatgtctatatccaggtaacaattacttgcttgatttgcaaatgatgctaaataattgatttgcaaatgatgctaaataattgatttggactgagttgtgcattgatgtatatggaatatattattatgtcctaaaattaaggggaatttagtgctgaaagactttgatatccgaagagaagctggtggtactggcaagtcaattgagaagacatttaatgcttctgtcacccaacatactttgaagattcacttctactgggctggaaaaggaaccactggcatacccacaagaggagtttatggacctctagtatctgctatttcagtaaaccctagtaagtcacatatcatgcatcttagagttagtgctttatatgacttgataagactgcagttgaaaccataatccattatgaatttaaaaattgtaggaaaagggaaagattaccactaatgtctacctctacaagacctccactagagttctgttatcaataaaattcatcattctttccttttatctgatccagttctatcagttttgttcttcatttatgcaaaagctaaaagtaaatatttttcccttgcacagattttaaacctccatcaggggatggcaaaagaacttatgtcatactggccattggcatagtagctggtgttttagtggttgttcttctggtgctggttctcatgaggaggatgggatggttaggaggcaaagatccagtgtataaaggtatggaatatgccaccaagttcttccaattcttttagttagaacaaatatttccatttgtttccaacacaacatcttttctgtatccagcagtatttgcctgagcttattccagaatttgtttaaataaatatttctacaaactttattcaaatgtcataaaactgaagtgcaacaatttacttctatataagatttgtaattgatgatatttctccatttcaccaaagtcaaggctttaagagaacatacgagagtatacttgcctgccctatgtattaatatgctagatagaaatgaaatgaactatgtgacagatattgtagagaaagttataaactttcttgttgaatccaaattaccaatattttgtttttattttcagagctcaggggcatagatctgcagacgggattatttacactaagacaaatcaaagcagcaaccaaaaactttgatgcagtgaataaaattggcgaaggtggctttggttgtgtatacaaggtacttttatcttccattcttggttacctattccatcttatggttaatttatttgttacttgatttgaaatagaagacacacttcatggtctctatatctccattcaattctaatttaacgcttacaatttaatcataatttctgtaatgtattttgtactcattagcaagcatgtataaccttcgtgggttaatgaaagagaaaaattatccacgtacatgatggttaaagtgtaatggagatttgttagatcaatcagcacttcagtagtttgaatatgtgtacctgtgtaatgctaatgcaagaaaaaaaatacaccttgttcatgatgcagggcctactatcagatggtacaataatagcagtaaagcagctttcttcaaaatctaaacaaggaaatcgtgagtttgtgaatgagatgggactgatatctggacttcagcatcccaatcttgttaagctttatggatgttgtgtggagggcaaccagctaatactgatatatgagtacatggaaaacaattgtctatctcgcattctttttggtaagcttcttgatgaataaactttagccatacttgccatttgaatcaaacatttgatataactaactaactgattgtccttctcccaatcacatacagggagggatccaaacaaaacaaaactagattggccaacaaggaagaaaatttgtcttggtatagctaaagctttggcttatcttcatgaagagtccagaataaaaatcatacatagggatattaaggcaagtaatgtattgctcgacaaggattttaatgctaaagtctcagattttggtttggcaaaacttattgaagatgacaaaacccacattagcactcgagttgcaggaacaatgtaagttcatattttgctactatttctcttgttttcatatcaaaccatggtaaaaatacccatttttaatcaatagtggagattctggtaaaaatcaaatgcatgtgtatcatactatgaagttagttataatttcaagcattaaatatttaacccatggttattgatgtactttattctgtaaagtatactcttagtcaaatccattattttaacaatgctaaatgctttttttttttcattttgcagtggttacatggctcctgagtatgcaatgcgtggctatttaactgacaaagcagatatttatagctttggtgtggttgcactggaaactgtcagtggaaagagcaatacaaatttcaggccaaacgaggattttgtttatcttcttgattgggtaattagaatttatcttaatgcataatataacaggctcaaacaaacaatagatactaaattaccaagacctatggattattgattttactagttcgtacatacacacatgcatatacgggcatatcaagtgagagggattttttgaaaagattaaatcacaaagttgtcatttttcagtgatcatgtaatcattaaatcacttttttttaacatcaaatgctagtttttagttttttatcggcaaatgttaaatcacttttaatcttaacgtatagttatttgtctagaattgctcatatatatatatatatatatatatatattgtaattctttttttagagttttagtatcaatttggtctaaaatttggtctaaaatttgagtttcattaggcatatgttttgcaagagagagggagtcttctggagctgattgatccaaatttgggttcagaatattcaactgaggaggccatggtggtgctaaatgtggctctcttatgtactaatgcatctcctacacttagaccaacaatgtcccaagttgtgagcatgcttgaaggttggactgatattcaagatctactttcggatccgggatattcagctattagttcaagttccaaacataagagtataagaagtcacttctggcagaatccaagcggaacacagagcatatcaatacctagtatttatactgattcctctggctcacatgttgaaacagaaaagagctatcatcctgtaaccgttaattcagatggatcagacaactgaaattcgtttcttaatgccacatatttaatacaaaactcgtggtgtattcaatgcaagaaaagagaaaaacaaaattaaaattaataacaatgtaaagagttttatcttgtcgctagttcgcacaaaatttggggtgtcataattagggatgacaataggtaggtctaggtaaggtactatagtatatgtttctatacttgcatttaaaaataatacccgtacctggtcccataccctttcaggtaataattttaatcttattttcgtacacgtttgatacctatatgcccatacccgcacctgtgactcgcacattacttatgtataaggttaataataataaattgataaaaataatttaattaaaacaagcaaacataacattaattcgtccaaactcaagtcataaataaaaaaaataaaaaataacatacaacatagtgattgctaaagctaatattttaatcgctaaacaaaaactctaattaaaggtttagtatttttcactctctaacagtgatatggttagagattaaagacttagagttttatcataaaaatataattatttttcacaaaatattatatatatatatatatatatacaatatccgtgtaaatttgtgcatatacttgtccggtacttagtcctattattatgggtaattatttatcccgcttgcaaatatttttgcgatattcataaaacccatatatactttgtaattcctaatcatagtttggagctatggttatggaactattcccatcacaatggggtgccttaatttagggttattcagtaatcttatttttgccttaaaaaaaagattagttataatttacgttgacatgtgaggattgctaacaaagtctctattgcttaaatttatctaaagctgcaaaatcatgtgtaaaagtcattaaataaagtgagacgtacaaaattttatgattttaaataaatattaattaatgataaaaaaagtgttcaataaagtatgttaacgaatatattactaacatttcttttgatatattgttaaaatgtttttaataaaatatttaaaaaaaatagattattagccgcgtagtccaaatgaaatattgagaggaaaaaaaaggctaattgaatttcagcatattttctttattagtgcacccaactataggggggagggggaagaaataatttgtactggtacacagaaaactctcttatttctttaacacaaacattttgctaatcaattgtacattttactgctcccatgagatatgtaaactatgcttatctatttattattcccttgtaacaattaacaaataatttgaaagtagaagtactgaaacgtgacttgcacataaaggcttaacaaatcacaccagcatcgttcttctggtaggtgatggatgtgacaccagtagcattatttatgccgacatgtcatcctgatcatagcaaagttaactttggattataaaaagccatcaacaaagaattatttacgttcgtgagaattatatatcaccttttggtcatcttcttcatataactaaattgagcctgtaagctataccccggatccggcaagccgccgctttgaggcatttgatatggccacctcaccaagcttgtcagcatcacttgatgtagtcctgacattgactggtgtataatgccgtaaccattccccaacgtaaacctgaagcataaaatagatatgatgaaactaggcaagagattgaaataagaaaggcgtcacatgttgttaggatccaattgcaaggtattgggtcttaagtcctacattggaaatatggggttctagttctagtgtaggatttataaggtcttttactctccaatttcaatgactaacttttgtggtgtgattctctcaaacttcttatcgattggtatcagagggtttcaccatgttctcaactgcaaacgagcactggagatcgtgatgccaacattgcagtgttcacctagaactaatcaaattatcaaagtgctgcaaagtgtgatgagatgtttggattcaattgcaagataagggacttgaatcccacattggaagtatgggattctggtatagttataaggccctgtctccaactacaactgctaatttttatcatgtggttctcccaagtttcttatcatgttgtatatctttaggtagaattgaagagtgtggtagttataggtggctctaaaagtttaccatacagttctaatgcattacgcaaatattgcctagtaccactgttaagaaatataatgcagccatgatacaacttgaaaaccattttccagtaaaacaagtgatacacaacaagtacagctacattagcacaatacagtaagcatgatatatttttaatatgcaagaaaatcataacaagaaaaatgatttaaagaaagaaattaacctgttgaggtctcaaaatctttgtatcaggatcatccaaggactctctccaatgagccaagtacccagccattcgagggatagcaaataaaacagtgaaatactcaggtggaaatcccatggccctgattgcataaaactattagttcaagccttgtatggtattctttttttttgggggggggggggggggggggggggagagggggcatatttttatcctccaagttagaataactgggtgaaataatggattacctataaattaatccagagtagaagtcaacatttggatatagcttcctcttgatgaaatattcatcagatagtgcaaccttctccaaggcaactgccacctgaacgatcaaataattacatacagaagttagaacttttgaagtccatatactgaccaatctacataaattacataggtactttcctggtcagggaaaaatagtgccagaaaccctagtaatactttaaatttgaaaaatgaaaggtgttgctagagatttttaatgtcttaagatcttcatttgacttgatctgctattttttttccaaaccaaacaagacatctaatgattatgcatgtagacacaatggtgccaaacttgtatgcacaaacatatacaatatacacactaagcatactattctgtaatcaaaattaaaaatacaaaaatacatttaaataaaacaataggaaattttttaaatgtagtagtttttctctgtattcacagccctgatcataggcctcgtgaccagcataccaagatcaaggaatatataacagacaatagacacaggaaatacggaatggataaacacctcaataagaggatcccggcccacaatggaaaacacttcctctgccagttttcttaagacctttgccctgggatcatagtttttgtacactcgatgtccaaaaccagagagcttgcgtttcctggaggaaaaatgcaggacaaaaatatcaactaaaactatcattttctctgcttgctgaaaagagcaggtatcatgctatcctttcagggtataagcaatgctaacaactaaggaaagagtaaaaaatagataacagaagaaagtaatactgtaatagccacctggctttgacaccttcaatgaactctggaatgttctgaacagttccaatttcactcagcattttgaggacagcctgcagaattgaaggtcacattaacatgttcccatattaaataacagtatagtgtttgtgtttattcactacgttcacctagcaatacataaaagatcatgactgcttcattaaccacttatagctacctcattagctccaccatgaagtggtccatatagagctccaacagccccggcaatagcagtgtatacatcaacgccactgaaataagaataagatatatagtttagcaatatgacggttttatatttgctttatattgcttaagtagtattgcagtaagatgtctaccttgatgcaaggtgtcggacagcagatgtagaacaattcatttcatgttctgcgtgcaggatgaagataatgtccagcgcacgagttagcctaggattgggtttatatgaccgattaccgctgaaagtatgcacagtggagattgtgttaatagttaaaactctaaaaaacagctagtatgtggctaccattctatcacttaagattgaattatacctctttttaaaaacaaaaatggatttgttatatatgagcaaaactcaaactaccattagtctataaagcaaagttaaatataaaaaagcaaggttgtcttaattcaaattaacgatcaagcacaaaaataccatacatacaaagaatctagcatgtataggaagttctctgtgtaagaaaggtggttggatggaagcacaggtggccttcctgccattctaagataaactgcagcagcaattgttgttatctgcagtaaataaaaaggggtgaaaatatgatatggcaataaagcagtaggacacataacaaataatcatagggttgcgaggatagtggacaaaatcccacaagatacaatcagtaaaaccagggctagaatcattcaaataactaaataatttgcatgttttcagagatagaacagtgaaaggagaagaaagaaccaaataagcacacctttccaataactcgtgttatctgtttgtctcttatttgctttgagtcataaatatcaagaccctgcattaattataaaaaaaaaaataatgaaaaaggatcaaatctggataaaggaatatacagagcaataacaataaacaatgttgaatcctaattagagaaagagtatcattcacaagtacattgtagtaacccacaggaaaaagtagcatccaaaaggaatcccaagattagttttattatatctcagtatctcaaatctctaatatgccccctcattcactccagagtcctttggactcgaagcatagacaatgtacaaatttgtattgaaattcaacttattaacaaaaaatgacttgacagcagtttttgttacttactctgagagcgggatttgcatcagggtgaaaaacagaaagagcactcatggcattaacaagcacacccatgggatgtgcatcatggggcatagattgtatgatatcctacaaaataaacgtaagatgataccactacttagttagattaataatcccaaactccattgaaagaaacaaacaacataatctttctattttattttatatgatcacttcaagagctactagatttctttaacaatataaaataccactggcatactaaatttcaagaagtaaaacaattagtggaagttgttcatattttacaaatctaaaagctgtcactgactgaaacaaaaaaaagttatcatttagcggatgggatttggagaacataaaaacacaataagagttggtttagataaagcataaaatctcaccaaaactccttgtggaacagccgaatgctgagatatagcaaactcccattctgctaactgactttcagaaggcaaacttccatacacttgaaaacagaaaaaaagatgcacgttaataaatttcagaagaattcatgctacatacatatcgaagcacataattaacaagaagcagaactaagcccaaaattcaagtgtcttcaataacataaaatctgtttaagtgaatcctcagtcaaaatgttttatctactcatacacaagcgccacagaagcctcatacacacatttgcagtgaaacagaacactcacttatgagataggacacttccgtgaaagtgcttttctctgccaactcctcaatagggtagcctctatatctaagaatcccctcatcgccatcaatataactaattgatgatcgaacaggagccgtgttcaaatagccaggatcataaagcttgagtcccttgtcattcttcccagtcgatatctgcaaatccaaaaaaacccataacataacaataactaaactaataagagtaaatagtgtatatattactttcattcaatcacagactacttgtatgttaagtttgttgacttttatgctaagatggtttcttattggttggtagtgtaaatttacactgagcatgcataaaaactaaactcaatgttaagtaagcacaaacagtcatactataatcacaaaccatcccacctaagatttcaccatgcaactaggaataggaaaaaagcccactttgcaaacaattcaacaaagatgaaaggagcagaattggtggagacccagtttgcaatattggaaattccttggaaagcaaagatcgaaattgaaaatttcatggatgaggaggaaatttaccttcttgaggtcagaagctttgacagtgccttcattggagacctgaagctggtacttcttgccggttctgtcgtcgacgacggtcaaagttccgtggaggttcgtcggcggcaactgagcggagagagggagagggcggagggcgtcgtgatcagtgagttcagaggggaggaggtgagcagcgagcatggccaaacggccacgagcatgcagcgtcgctgctgctgcatctgaattgcttgacatgttctctcttcagaacacaacaactattggaattcagagagaaaaacggaggatttggagttggaggaattctgaagctaaaagagacgtatacgctcttaactaataataacggataatcttgtctacgagtttagacttccgagaaaaatattaaaaaattaagaaacttgttattgcaattttttacagtatgtaacaagcgcggagtagttatcatttattaatcttcgtagaggacctaattaaccatgaactattaatggtatggtatatgctcaatttagtccctaaaatatatatttgttgacaattttacttttatattatgaaaatcatttatttagttcacaaatgtaaaatgttacaataatttggtctaatcgttaaaattatttcatattcattattggagatagtctacatgactcactcattcacataatgacttttcacattatttttgactaaattatcacattttttttaaatattgatttttgaaacaaaaagtaaaatttcattctaaaattttttcaccaaaacatatatacttactaacaacaaattaatccctaataaatattatgaactgataaactagtcccaaaaaagttataacatacacttagtaatataatcatccataaaataagataacatacacgtaattacgaagctaaatcgagcatttataaaatataaaattgttattcattaaacataaaatatcgaagttcccaagtagcagtaaaacttcaaccaaagcatgccacaatgtcaatgtcataatagaaatttccaaaaatatatccaaaatacatctaaaacacgttaatgcctaacttttcaaaatatatccaaaatatgtttaaaacacgttgaatccttttgaagggagttgaggtagttagatatgtggtataggatgaagctcatcaagcttgattgtggcactcttggagatacttcaacttggaaatgaaactctaagcatatgagtatttgcagatcggataggaagtggtctaagtgcatgtgtaagtggtacaaatgttgtgacattaggagctgttggtggtgtaacttcaattgcaaattttgagaacaaaccatttcttcatgcattgaatgaatgaaattaaaataagttattatattgatgattgagagtaaatggtttctaaataaataaaaaaatagataacaaaaaatatgagtatactgttatttgagttgttccagcgtaataacagcaactacaagtaagtgtttccattttttaggttgcagcatctcatacaagtaagagtgggaaaattctttgtaattgacatgatatttaaaagttaatttacagtttatttaattaacttgtaacattgtttaacaagagtaaaagtataggataaactaaatttataaagaatagttagtcttatatttatttgttagcgttaaaattatgggttgaattgtcttagatctaatgatctgaaaaatatatgttcatcttaaaaaaatataaaacctcatttatcagtttttaattaagcttataaagtatgaatggcgcagctaggtaagttgcgcgtggcatgaattgaagagtgcgggaagagaaagtgaaaggaagatgagggtggcggaggaggagaaagcagtgttggagcaagtgttcgggtcgtcatcatcagaagaatctgattctgatggctacagcgagagcggagtgggaggccatcacagaagtgaatggcctatggctgtgccgtcacttcctctctccacgccgccagtctcacatactctcctccatccaagccgccaattggttcccctccccttccatcaaccaggccatgcgcttcggcctacaacacctcccttcttgggccacccctctggcccactccatacgccgctccgtccaagcccaagcccagtcccagtcccaggcccccttccccctccacctcctccacagagaacctctcttcgaccagatgatcgccaacgtctaccagcccggcgaaggaatctgcgcccacgtcgacctcctccgcttcgacgacggcatcgccatcctctctttagaatcttcctgcgtcatgcacttcactcccctctctggttccctttccgttcccgttttgctcccccctggttccttgattctcatgtccggagaagcacgctaccgttggaaacacgaaattaatcgcgcaccgggtttcagatatggcacggtcaaccattgactcaatccaaacgcacctctatcaccctcaggaaactttgcccctcctctccctgattccacactcaaccctttctttctgttataataatttcaatgttctattatcagcattcactaaacaaatttcattaataattgtagtaataacagtaacacgtatcttatctatctatctatgttattcggcgttgtttgatttgctactgaacgcgatgaaattcagctgatatcgtctgataaaatcatcgtgttatgcataactcatattttatgggcgaatggtgtgcaatgcaaccaaatgaaagtgtcatgtgaatgtgacgattaataccgagcaaatcaaattatttatgatttatcacttacattgatactggcgcgttgtaggatgaggacgagttcttctggagtgagaaaaccgaaccattgatgtgtgcctctcggaagctgccaagttcaaattatttatgtcatatatactggccatcggcatagtagctggtgtttagtggttgttcttctggtgatggttctcatgagcaggatgggatggttaggaggcaaagatccagtgtataatggtatggaatatgccaccaagttcttccaattcttttagttagaacaaatatttccatttgtttccaacacacatcttttctgtatccagcactatttgcctgagcttcttccacaatttgtttaaataaatatttctacaaactttattcaaatgtcataaaactgaagtgcaacaatttacttctatataagatttgtaattgatgatatttctccatttcatcaaagtcaaggcttattaagagaacatacgagactatacttgcctgccctatatatttatatgctagatagaaatgaaatgaaccatgtggcagatattgtagagaaattattaactttcttgttgaatccaaatttccaatattttgtttttttattttcagagctcaggcaaagatctgtagacgggattatttacacttagacaaataaagcagcaaccaaaaaatttgatgctgtgaataaagttggcgaaggtggctttggttgtgtatacaaggtattttgatcttccattcttggttacctattccatcttatggttaatttgtttgttactggatttgaaatagaagacacacttcatggtctctatatctccattcaattctaatttaacgcttacaatttaatcataatttctgtaatgtattttgtactcattagcaagcatatataaccttcgtgggttaatgaaagagaaaaattatccacgtacatgatggttaaagtgtaatggagatttgttagaccaatcagcacttcagtagtttgaatatgtgtaactgtgtaattctaatgcaagaaaaaaaaatacaccttgttcaagatgcagggcctactatcagatggtacaatgatggcagtaaagcagctttcttcaaaatctaaacaaggaaatcgtgagtttgtgaatgagatgggactgatatctggacttcaacatcccaatcttgttaagctttatggatgttgtgtggagggaaaccagctaatactgatatagtgatatatgagtacatggaaaacaattgtctatctcgcattctttttggtaagcttcatgatgagtaaactttagccatacttgccatttgaatcaaacatttgatataaccaactaactgattgtccttctcccaatcaaatacagggaggacccaaacacaacaaaactagatggccaacaaggaagaaaatttgtcttggtatagctaaagctttggcttatcttcattaagagtccagaaaaaaaaatcacacatgggatataaaggcaagtaatgtattcttggaccttcttatcttcattaagagtccagaataaaaaatcacacatagggatataaaggcaagtaatgtattcttggaccttctctgctaccacgacggcatcgccatcctctcctttgaatctgactgtgtcatgcacttcactcccctctccatttccctgtccgtcccattttgctcacccctggttccttgattctcatgtccggtaccggagtttcagatatggcacggtcaaccattgactcaatcagcaccctcaggaaactttgcccctcctctcctgattccacacttaacctttatttctttctgttataactttaatgtttattattcagcattcaaaacaaatttcaatattcaatactaataataattatagtaataacgtaacatggatcttatttatttatctatctatgctattcggtgttgttttatttggtaccgaacacaatgaaatttacgttgatatcttctgataaagaccaccgtcctgtcaccgggttatagacgaatccggccatctcctccacctgtgtgtgcaatgcaaccagaataaagtgtcacgtgaatacgatgattaatctctaacaattgaaattatgaatgcgttttgcgtatatacattgataccggcacgttggaggatgaggacaagttcctctggagtgagaaaactggaccattgatgtgtgcctctcggaagctgtggagttcaatatatgtataatttgtcgattgaatgtaggatggaaaaaataaatgttgaatggagttgagttgagaagaatgaatacccagtggagaatgtattctgcagcaacaatggcagttgcgtaggctctcatggatcgattgattgtggatatcacagtggctccatctggaactgttagtgctgacagagatttgcagaactctgcaggatctgccacgtgctcaatcacctgcaaaaaaattcaaagcaaatgaaccaatgcaaggcaaaatgtgtccttcaactccactgagtactgtactactatcaaagattttacggtacatgtatgtcatatttttttttttttttttttgtatcccaacacccatgtatgcactccaatctgcaagcacacaaccagaaagaggtaaggggcacgaaagagaaagtacctccaaggccataactgcgtcaaacgttcttccttcttcaactagcttctctgatcagtcaattaaaattgttggtgagttgtaaaatgcagtgcataatacccaaaaacataaggacaatttgaaacgaactagatgaatgcaagcaacttttccttttacaatgattattgaagccatcatgcatgtactgatgtaccaagagcgttcaattttttacaaacatgctactaattacaaagaaatgatgacatcgcaatgaaaactataatttcaactatagaagatgaaagaatgttaagtatatgtaatgtaacaactcttttagcttaaaacttattcacccacttgagcgatttagcatgtccaagtatgataccttgtataatgagaaacattaagggatagagtaaaaactttcttcaatgtaagaccctagtaggaagacataagatcatagcaaaaaaaattgacttttctacagccaaatatacattctaagactcttaagataaataacataaaatggttattaactacaagctgtaagaaaaacaagaaatcacaagccaacaggaagtgaaaatattgaagttttttatgccaatgcatcatgatctcgtaacttttgaaactctaaactatccagtaaaggtctgaatccatggaaaaaccactcagaaaattagataaaaggaaattatgccagtcagacttgtgcttcttatcaagattgtgaactaaactgtattagcattcatttggataagtagggcatttcagcagtagtgtccaaatgttaacagacttaaagcatgcacgtccaaaatggatgtaaaacaaaagtgtaaaagaatgcttcaagatttgtaaatgtaccagctgtcgtgcaacagaactcaatagatgaagttgctggatccaaaccctgttgacaggagataataagttgtccggcaaatagtgaagatttaatttactaatgttggcaactgcttcctccaatatatagaatacagcaatctaatcaatttgtaggacaagactgacaaatttcaaatattcaaatatagaataagcatacagcatgaagttgagcaatcttgatattcttctctacagcatcaacacccatcacagtagctcccaatcgagctagtggctgaagaacaaaaagagaagcatggctataaattataaaatagcaacaaaaaagagcacaaatttgcaataaaaaaacaataacaaacttaatactctataagtgaggggaggccaatatgcaccaaagaaataattcagatttccacaattcaagtattcaacctaacaaatatagtcacctcgaatccatcataatgctacagattcgcatgaggattatgataacaagtaatatagtcaacaaatatagtcatctctgaacttattataccaaactataggtttatcataggccagaagataaaaaggaaaaggtcttttccaaaaatcacaggaaaaaagaagaaaagatatacctcagaaagaattccacctccacaacctacatcaacaattttaagtccttcaaggggtttagcactataagggtccttcctgagacaagggtgaaatctaattattatttgaatagaatcccgttagagacaaaataaaaatataaacccattgtcaaccgtaataccgtttttcctattgtttttcttcttgtttcttcatttggtttgtgtcaaaaaataattcagttaacactttttattaacagatacttcattagaatcatcttcttacacatccttatacgattatatttaattcaaggggtattaaaccaaattcctaccatgtatgtgtagcaaacactaagtgctattggtttaataagactgcataaataacagtggcttggaatctgacacagtacaaccagattatattttaaacccactaattccatgcaaaaaaagaaaaaggaatcaaattataacatagcacaaagcattgcacattctaccaaagtagtttcaagaataaacaccccagactcaagaatggaggtacaaggactaaatgaaagagcaggcttacttgaaatgtcgacaaagtgcagaacggatgaaagcaagtcttgttggattcatcacatgcaatggcttaaaggggccttcagaatcccacctattcacatcaaggaaagggcaaatacatgtcatccatattctcaaactaacacacacacacacacacacacacacacacacacacagtagcaacaacttcaacaaattcaccccatgaaaaaaaatgtgcaatttaattttaattgtggtgtttataacaataaattcattgaacagattctctctttcgtttcgaaagctgaccaggtatcggcgatggcggcgaacttggcgagctcattgtgcttcaaggatgatgatggaggcgaaggttgttgtttgggctgcggttgaggcattgaagaagcagcatcggcgaagaacctagtagtagcgttaaggagaggctgaaaacgatggtggagaatgcggtggatggagatgcgattgaggtttcggagatggttgaaagccatggccacggcaatggcaatggttccgcgctcaaatcttcgtctcttttcctgaactgaacctgaacctgaacccttcagctaggtagatccatggctgcgaacctgtcggagctcctgttttgaccagattgtagaaaacgggttcatgtttttaaatatttagaattttaaaatttggttaaatagtgtattttatgtcccatttttttatatacatctctccatttaaaaattcataaatctagcgatgttaaaaaaaatctaaatataaaacacttctttaactcttccacccaaattatactaaagaaagtcataaaaggtataaaaaatatgtctattcacatcaccctaaaaataagattaaagagatgaaaaattgataatttatatagagttattaaatggatccaaccaataactaaagcgcaatatatgaaaagaaagcaaaatacaacactatgaaaaattcaataatttataagaataattcaataattttttaaataaccattttcaattcaattgataaatttagaaaaatatttagtgaaaaaaaaataaagaatgagtttgattgtgaaaaaattggtgagaagtgaaaaaaaaattcaaaaatataaaaaagtatgataccttcattacattattttaatttaaatatttattttcaaattatcttttattttattctctatcatcttaccaaaccaatccttaaattttattatcatataactgtaatattatattcttataaaaggatgtagagcttttaagtgtcactggccatttatgagtagttagtaagatcatttagtagtttataagttattttgactagtttataagatagtataattaaaaaaaatatattttatataataaattatgatttaatgattgtataaaatattttataatatgtataattattttctcattttttattatatatccaccgtgttctacggtgaaggttcagttttaacaacgttcatcttaaaaaaaagtcattaacgttgcaattaatttaattagaatctcctaaaaaaattaattagaaagtcaacattggaaaaatatcagaaaaaaaatctgtaagaaagtcaacttaaccatctaagcttttatcttaaattatactattagaaaatatagttgtccaaaaaagaaaaacttagttaggttagctagagaggcattaccgaaaaccgacgttgttccttcctcgatggagtgtgtagtaagaaaggcggtgacgtcaaagatttgaactagtcactctctgacacaacacagaacccgatcccatcctttatcaattgaaccaaaaaatcattacatacacattaatgttcattcacacactctcttattctcatcccttcttcaatccaatccaattcaattcaatccacattctctctcgcaccgaaaaccctcgccgccgcaatggaaaccaagaagctccaccctcgcttctcgctcggccgccaatcctccctcgcgccggagcgcgccggtgacggcgactcgtcggagtcgctggacccggcggtccgtttgatgtatcttgtcaacgaaggtgactcggacgggatcaaggagctcttggacgccgggagtgacgtcaatttcaccgacattgacggccgcaccgcgctccacgtcgccgcctgccagggccgcaccgacgtcgtcgacttgctgctccgacgaggcgcccacgtcgatccacaagaccgctggggcagcaccgtaatttcactctctttcgctcttctcgctgtctcttattctacactcgctgaccctaatttctggattggattgtttaacagcctctagttgatgccatgtactacaagaaccaccaagttgtcaagcttttggagaaacacggtgcaagacccccggtatgtctcttcttcttagatcttattcatttcctctaaaaataaagatgttattcatttcgagagattaatagatagatgtgcacttttggtgtggaattttttacgttgtctattaatcagatattactttttgtatgacttttttaagtagttattataaaaagtcaaacatatttatcatgaatggaaatataattttttttacgctgtctgagcatacatataattccagttcgcctaatagttcaagcttttagaagagaaagtagtatataaactgacactgtacaaattttttatatttcattcaatcacaattcgtaataccatattgttgtgtatggtaggttgtttgatttacaataaatacgttatttaaagagaaaacacttttttgaataaaataaatagttttctgctcttttgatgtgtttgtctaactgttttttttccttaaaaaagtagtactagttttctgttttttgtttaaaaaagtattttttacaaatcctatttgcttcttaaaaaagtattttttacaaatcatatttgtttcttaaaaaagtattttttttaaattgcttttacactgcagtgtatttttttacactgacagtgcatagatattaaactccttttagtataggttgtttatgacatcaagttgcaactgaggactttttattgtagatggctcccatgcatgtgcagaatgctcgtgaagtacctgagtatgagattgatccttctgaacttgattttactaatagtgtttgcataacaaaggtaagctttcaagtttcctttctctgtatggtcaattgttttgtaacttgatttctccttttaccttgttttgacatattctctcaagtcaatttaccctgatttattttttgtttcatattttatattgaatattagggaactttcaggattgcattatggcgtggaatccaggttgctgtcaagacacttggggaggaattgttcactgatgatgataaagtgtgggttggtctacctatgcaatctgttgtttcattcatgtcaattactcaattggatattcagttctcaatttttgttctcatagtggattttgtttgttggtgtctgtttatcagaaaggcatttcatgatgagcttacattacttgagaaaataaggcatccaaatgtagtccagtttttgggtgctgtaacacaaagcacaccaatgatgattgtcacagaatatctaccccaggttagtcttggtcctacactggttatatggaagattttttatgataagttattttgcccgtggtgtttatgaacaaatcatattggttagttggctaatggctatcatagataatagtgagctgaataaaatatgtggtcagaaatttatcattttggatatagtctttggaaagaaagtgactagcgtaggttcaataggactacttgaaatctagcattatgttggaggcacaaaaaattaatacttaagaacttaatatgataaaagttatactgggactgatactaattgttgaagtgtcaggagttatttgcaattctgaataggccagacaggatttggccctctaagtgaaaaagtgagggattatctacaattgatataaagtcggttatgtatacaaaatgctttaattcaaattgatgattggtagattcttactttctcactttctcactttagaggaactgaatccggtcagacaattatgttcctgttctgtctagaagttataaatatctaaattgaaggattttaagtaatgataagagataaccattttagtctagtattgataagtgctgaattagaacttccatttatctttattgggatttcactttatgttagtgaaatggtgaaaaaaataaggaagtgcatataattaggaagatatctcctctatttgtgtgtataacgtggttaactataccttgtatttttcactattgtaatgtctgacaatttggaatggattatcatctctttagggggatctccgtgcctacttgaagcagaaaggtgcattaaaaccagtaacagctgtaaagtttgcacttgatattgctaggtcagtcaagagctttcatattatggatgcatcactagctttcagttggtttgcaaggaagcaagctctcctgattatttcatttgttgaaaagttgaataattaatgaagattttctcctatattaaaaattttcatttggatatttgtaataattccaaaatatgtatattttgcaggggtatgaactatttgcatgaacataaaccagaagccattatacacagagatcttgagccttcgtatgttttatgttctcctgtcctgtcttgttgattttattattcttccagcatgtgtatgaagtatcgtggacttttcagtagaagcatgcatttttaattcattattgaatggttagaactgtttaaagtttcttcattgtacatgagtaagacaacagaaatatactgcgggatgattctgggcatctgaaagttgcagactttggagttagcaagttgcttaaagttgctaaaacggtcaaagaagacaaacccgtggcaagcctggatacatcatgtaagttttcttctttagtggagccctggatagataatgcaagttttcatctttagtggaaccttgtaatattcgtggtcaatcatgtcggtctgcataaaagcaatattgtgaactcttatttcatgagggccgtaatgtgcacagtgttgcatattctgcaaggaaaaaagaaatgctgtctactcagtgactaccatagacagttgtcagctggtgctcaattttactaatttgaatttatcaattgatttataaatatggccatctcttatatgtataactggttttattttaatcctattgtaattggttctgatttcaaagtttgtattgatgaatttattcaaatctgtaacagggcgttatgttgctccagaggtatatagaaatgaggaatacgacacaaaagtggatgtattttcatttgctctgatattacaggaggtaaatcattattgctcatctttggatgcatgctgattttccttattttagagcttttaaatgacttccaagttaattatttacccttattatgtgaatggttgtatcttctctggtcttgaaacaagacttttaaaccctaaactggcaaattaattaataaatataaaatctgtttgatgaattgatgcttgtggaatattatagtggtattgagcaattaatacatgctaattcaatactctccgtcccttgtaatttctgtttatctcatcacataaaacttttaaaaggctgttaattgcatttgctttcttaaaaaagaagggaatttactttatgttgtctgtgctttttcagttatattttgagcaattaaaagcatttacataatcctgaacataaagtcatatcccctacatacatacatctgtgttgttcatgttagttaaaaaattggaagttcaggaaaaggaatgcattgagaggtgtatcatctgttgctgtgtatcctatgttgcttttggcattcaaattccttcagcattgttacgtcatattgaattttagatgtttgatggtgtcttttacgcataggacctctttcacttgtcaagtaaatacgtataggagtctatggacagctcaagcattcgtgacttgtgagctctgcctgctttgtccatcagataatcctaaagatatgtatattatatataattgtgatatacaatgctttattgcatattttaaggttgatctaatggacaggtagagttctagagattttgagttctccacatattgacccaaaaaatataaatgtttgtatatatgtgtatattcatggtcatttaagtaagatggcccaacagtttgttgtggtaccaatatgttctcgtacttttttttttatgtgaagacaaaatgttcattttctgaaagttcaaaatatgattattttatttgtggatgatgggcaattttgtatatagaatatacagattgacaaccaactgtaggttgttatttgtagagatgcccagcaaaatattgacaggaacttgcatgattttctgttcctctagatgattgaaggttgtccaccgttttatgcaaagccagaaaatgaagttcctaaagcatatgttgaaaatgagcgtccaccatttagagcttcaccaaagctttatgcttatgggctaaaacagtgagggttttaaatacatttaattggcagcagatttgaatgtttagtttcaaaacctaccacaagtaggaaattaaattaataagtttttcacattcaggaaatttgatttgtccataggttaattgaggaatgctgggatgaaaaaccgtacagaaggccaacatttaggcaaataattgggagattggaagacatatactaccatcttgctcaaaagaggggctggaaggtatccctttttcatgtgaatatttctttcatcaatttttagacctagttatggtagtatataacttcgcagtaatttttaatactaaaacttaacagaatgtgaggaatttcagattcaaagactttttctgtatcattggatggatattaataatttttataccaacgtaattttactagagtgactgtttttaatccatctcaccagtagaatgccctcaaaggtgtggatattgtgcgatatagttattttacaacgagactgtgtgattctttgtttcctaaggtgtaatattttcttgttatgatacacaggttaggactcctggatgcttccagaatctggaagccatatttaggggtaatcgcacaaatccaagtagccgatcatctcgctttacggccagataaatatttgccttgccatcaagaaccaataaattttttgatcatgcagtatcatatacttgcacgtcatatatatagttttttgtaaataactttcgctcgacgtgcggttgaataaattctgaaacgaatgtgacatatcattgtgtaattttgtccaaagacattctttctagttcttgcttataaaaaaagttagttcttttctaagctttatctttttaaaatattattttaaccttaggcatattttgttaagacgctgttctttttcaataaagaaggtaccatgtcgttgctcctattctcatgtgtgggcctcaagagaattgagtacctgtttggaccggtgaacagttttactttttaacactgatccttatgttatcttgtttgctttcatccatctatttaaatataattgtaaatacgaagatttttgctgcaaaattaaaacaacgaaaattgtctttgcaatatagctaagtggcaatgttttgcttcctagtttcttcctcagtaatgatgctgctgcctatgattctgataacagacaaccttgcgaatctgaatgcaggacgatgatgatggatagaagctgccaatgtcttttcatttgtcttttttaggaaaaactcaaacattttttttatccatttgaatcaaagaatttataataactgtttaatcaattaaattaaatccttttactgtttacacttaaaagatgaaagaatttttaaggaataacaaacaaagggtcattttgttacatgcaatcaaattttgttgtcttcttttttaggcattaatttttttttttgtagtttctaacacactgatttttctctgtgcccgtttcgcatgcgcttcgcgcaccattggcgctttgctctcctcttattcttcattggaggttcggatggacttcgccgttctttcccaactaaaatagaaaaggcttcagaagcttggctagttctccttactcggacattctgttcatccgaccactgtccatgcttccaatttcgttgtaacgagatctagttctggagttagagttaacatcgattgttaaactccttttcggagagctcagaaaatgcagactgaaagtgaaactgtgttatttccactataatttttagtagtctgggaacacctttaagccgggatctgcttttgcaatgttttgtgcatgttcgcatactttgacctatctaatgtctaggttggttcagtgccattctgagggtttgtaacaaatgtgtccagatgctgctgcaactgcaatactgcaaacaagtctacgacaatggacagtggacataataagagcattttgaccgttggcgttacctatttttatatttcttttttcataattcaaccttttatttaaaaaagaaattatttgttaatgggtttgatttttttatacattgttaatgtaaatatttttataatgtcacgtggaaactaattaaaattaccttaatatcactttaaaaataatcttataaaaattaacaattttattatatatgttagtttatgattaataataatgtaattttttatgttatcattaattcaaaaattgataacgttgttaacttatttcatcaaaaatttagaagaaaaggatattcataaattgaagtctaactagacccttaaaaactttccacttgtaaactttgaaaaagaaaaatcattttagatatttgcattccatgagcctagtacattttacaacttaggttgggttgcaaataggactaatggatttcgttatgagtataaggcataagtatttattggtttttggtttgagtgacagataacttgatccccctcaaataaatttatgagttgtatatataaaacttaattagtctcttaactgtacaaagttctaaatttaaaattagcatttgaatgctaaaaatttaacaaaaacatgatccactgtaagttattcccccacagaagcatatcacaactttgactaccagaataccaggatgggattacctttctctataatttgtacccaaacagtatttttgcttacctgctagtaattaatttttaacagacgatctgaaatctgaaaatatataaattcaaaatttaagaagaatcaatataatgtttgctttactgctcgcatttaggcatggacaatcaatgagttcttttaaaaaaattaactgatgttttcaaaaatttaattatgttgaaaataattaatatgtattctctctatgcttaattataaaaaaaaaatatgtattctctatatgcttataaaaaaatatgtattctatataatagaagttatacactaaaactcaatacgtttggtactttttttaatgaataaaagatgatatgataataagtaatgatatatcaatacatcagacattaatttaaatatcatttatgttaacagtggatattcattaaactcaaaaattgaagtcattttaattttatcgctttcacatatatacaggtacttgaaaatggaagttgaatttttatttgctgaaggtttgttgctttctttttttccttactgcttgtttggtttaatgtttatcacttgtcgatcagtatttgatctcaagcaggagctataaatagtagcttctatttttctttcatgtcattgatgtgaaaataccacttctcaggtatttgatgtataacaaaacacaggcttaatctctctctctctctctctctctctctctctctctctctctcttgttttcttgtttaaattaactgtctagactttacaataagcattaggcagcacaaaaaacaacacgttcaatattattatttttgcttcttttccaaataaggagtataaggctaaatgagatgaacttttgtaatttaaataaattgaatgagatgttagttaatttgattacgaagtgattttattgatttgtaaccagacctagagggagacatcaatcctgtttgatagttaaaactacatatcatatgatattctttcatttaggccttaaatgaaaaggataaatatatacgtccactcattgtgagataaactgaggtgaattagttttaaaaaaaatataaataagatgaaagataaagtaaatactactacatcttaatgagggttgaagtgaaaattagcattaccaagctttcccctcttattattctctgttaaaacttaaaactaaaagtgctacaatttcaaatttaatggtgcctcgtttctgaaacaccaatcattgtcatactagtgttaccttcattcttaattttcacacgtaaaattaaccgctgcaacaacacacacctgacaccattacatgttgcaaccgtatattctactttagtacgatctgaatcaaacagtgaaccttaaagcatcaccagacacaaatgaaaagaaaaagatcaatataactaagtagtaataagaaagacaatgtcacttttgagagatattaataatttaattaatttgatacactgatctttatgctattcctatcaactaagttagacattatttgaataagatgtttgaaataattattacacaagttgatgattttcaattatatactaaaaaccaaggattaaataaaattacactgtaaaaaaattcattattaattaatatattataattaatttctaaattatgttcatgagccatttgtgtacctgagaacaacacaagcttggctcagaaacaaacttaagtggtaacaaagaagtgaattggatgtgtaggttgagacagatatcgaagctagctaatatatatctaattgctttttcttcggttttggtgtctcatttgtttgtatatggaaattgttaacttcattcttagttatcatgtgctcatccacatcttaaacatgcttaatagtattaaagtgaagaattactgtttaagtaagtaagaaaagtgtgtcttgtggagagtgaaagagagaaagacgtacggtgaaaggagggaacctctttgtctgtaggcccattttggcttacaacttcctatttgagtgccattttgggagctgtcttagcacagttacttttgtctccctcttaattacctggggttgtaattttgtaaatactctttttgatcttttattacttcaaattactctatgaaattacactcttttatctatttcatagatgttttaactataatactttttattgtcaaaagttatactatttttttttcaagagataggtgttcattttattgtaaatgagtatttcaccagtaatttttcttaattctcaattcagctttattgatggccaatttttagacacctactatcatttgagacttcataaaataatcagtttgaataaacttttaaatctgacagtgaaagtgttcagattttcattttcttttgaaatgttaaaagtcaatagtaagatgctcaaaactatttgtcactgattaaaacttagataaaggaaaaatggtcctgtaattttatttataattactcattatttgaactcttaagtataaacaggagtcaggagtataattaggacaattaaatattttattaaaagtatttttttatcataatatactttttacctacaaagaaacttattgtgtttgaaatcacgtgtgtgaactgtattaactgtggaaaccaaatccaataacccataagaggcataaactacaacatcttgcttctgaataatgcggatctgggttgacacaatgcttaagtaaacacaacttaaattaattaacgaaaagctattgatcactaagtgcgtagattaattgatggaaattgttttaaagttcgtttgagatccaatagttgacataggcgaacatagatgacaagttaatgtaaccaattcaaattttatactacaaaagcaaagtaaaagagtttgagtagatcattagctacctcaatggcatttcgtgcgtctgacttatttttctaatagatagattgcagctagctgtcacaatatgttgcatatatagcaaatctgagtcatatgatgattaagatgaaaagtttcttaatatcacatgaccatttaaaaaaatgacgttagttttatattctaatcttaaccatctataataaaatccaatggtcaataactcaatattcatttctcttactcttgcataaaaaacttacttttatatttcctgtaaatgtatataagattgtaactttttctaaggggaaaatttactgttaattcacaaaagtataaataaaaaataaaagtatgactttaccataccataaagcataatgtgatgtgaaaccaaattaatattatcaaaagataacccaacttctttgtagtagttctaaggagcaagtgagctactacaaacataaaatctcacaacagaaattaaaatcagaacctgcagcaggaaatttaaaacctttatagtgtaattaaaggcagcagcaacacagcctaacagcatgaactatgttactaacactgaaatctaataggtttagatgccaacaatttatatcataacgggcaagcacaaccactcatgactcattcaataagctgttctcatcaaactagtagcctagaacctctttccttcaacctataaaagctaaataatcaggattacaattagtgcatcgagtaacacataatgcacaaatgtgaatgaacatacaatttgtttattgagtaattagcgtgatcagatttcctcatccagaaagccacccgtcttatttcttatatatattggtgctgttcaagaatgaactaacagtgttatgatattaccatgacaaatttcagctaccaccttgtctctccttacatatcatttggtagtaatatagacaaaaaccacttttaacttttaagcacaaatgagtgcttacacccttattaattagactcaatgattttctgtaaacatgcacctacagaggttttctcatgcaaaaagttgacaggatcacatcagcctcataacaagtacaagatatttgtaagagtttatcttcgaccaattaataaattccaatttacagatgattcctctcttcgtttcgttttcatttttgttctccaatagatattccttactcattaattcagcaaaatccatatatatatatatatatatatatatatataaatgaatgtcttccttgaaggctccataatccttagcatgatgaacttgataattgctatgcatacttagtttgtgcacttaaatgacatagcaattatttaatttcttctcttttgatgcttcttttgacttaaaaagataagaatttagattcttttgagtttttatcttaagaatgctaaagttagtaattttacaatgttttgttctattttgtagagtttttggacacatcaacacaagaatggaagatgtatgaagaatttgagcatcgcgctcaacatgcctcagcgcgagaagccaatatcatgcatgagtcctaagtgcgcaattggaggcttagcgcttggtcacttaagtcggttggactttgcatgtgcgctcagcgtgcacatgcaggtttagtgcacattcattttcgaaaaacacgaatgtgcagcattttgaagaataaaaaggaggagcactgtactattaagggacaaatagtaaggcacaatagggaacgaaaacccactcacttggagtccttcttcttctatttcctttgcttcattttgtatttctgagtctctcatgactatgagaggctaaatcacccattgttgggggctaggcaaccaaacactcttgatgtgatgatctttactaaccattttatgctattttaatattattgcttcttttatgagtttattgtcttgtttatgatttgatcacccattcacatgtatgttatagggttttaatcattgggaaatgtttgtaccctaagaacttgaaggagcttctaggtaatccatgtttagggataaaatggtgttatttagccttaattatgcatctttattcttaaaacaaattatttgatgtagttcttaagggattaggagtgaaattaggtaatttaggctattttacatgaggaaacatggttagggtaatttagaggataaaggtaatagttggaataacgttaaatggtgaaaaatctctaacattgcatcaagagtagtttcggtaggtcgaacacccaacacgtccacaaaaatctgcaccaaacgacaatttacacctccaagcatttgtttttctgtctcttgcgtgtgctctaccttgttatctttatttacggttgaattttgcatgtctgcattatcacttgacaagtatatagtttagtcatttattagtttaaacttagatatatacaaactctgagtatagttaaagtctatgtggattttgacactcggtcttaccgttttactactacttagacgaattggtacacttgccaagtaattaacaaaactgaaactcagaagcattcagttcttgagctactacctcacaataaaagaaataatgctcaaacaacaaggttaatgtttctttcacattaattggaagtcaatgcttttgcagttcaaaaccatacggttagcaaattaaagaaactcaacaaagtttattttatatctttggtcccacaaaaacttggtataaacaaatagcattaagtaactaattaagtttccccaattaatagttctcatgctttcgtttcattttgctatatccatggatttaatgtcataaatcatcaataactagatctctggaagatccttttacacctaaaactcaaacaaatagttctcattagtatcttcaagtctctaaaatgttgtttgtaatttaaaagcaaactctaacatcaaggtggaattccaccttatttgaacaccccagacacaagtgatttgcttttcatctttgtacaattcgtcaaatttttaatctcactatatttctatagtcaaattaacttaagagttaccccctccttttgtcaatactcagtaggtaacaaattcaccataatcctcttgtggactgtgtacttctttatctataaagggggaaatgatgcacatataattaaattcagattttgcatccacgttcagtccaacaatcagtagtaaggcttacattttgcaaggtaatttacataagagataataagccctttcttatgtttttatttatgaaaattttaaaactgttcccttgctggttgtcattgtacatcctggatggaacattaaataaaagctgaacaacactcaagttgtatctaaacccttctgctttcacaaaaacctaaagggtagctctttcatgattgctatcctactcaatgcctctcctgcattaattgttcattcaattatcaaagcaaacaacaaccatctccttcatcttttctttctgggtggaatgacaacatggtttacttatgaattatgatccccgaagagcttcagaaaaaatctagcattgcctcaataaataaatgccaatcattttttaatttcttgttcctgtctgaagcaaacttaatctcatgcatttcatttgtgacttatatttatatttccccattgagaaatgtctgtcagtaacagactcttttgaatatactctttattatggattaaaatttattcaaaactcacaaaactttgctcatctgcctcaatcataattttgtagttttcattaattaaccataaattaaccatcgtatagggaatagagactgtattgctaacactcttctaatatcccccatttgaatgcataaaacaatttcagaaaaatattccatactcatgatggaggtctagttggaatttcttgttaccttcttgctgtatattgtgttgcagttgtttgatcctcggacttggttgttgaggtttcaattaacagtgacttggggaccttcaattctcttggagggtgcttgcctgcttggactgtagattctgtttcaacaaccttcaaaggttgaatatcaatctcctccaacttcttcatcagccaggatcagcaaacaggaaatgatttcaacaataagatgcacttgaatctgatcctcaatctgttacaggaaaaaaaaaaaaaaaacacatcattggaagagaaaggaaaaaaaatcaactgaaaaaatatccaaaatatggttgaagtttcaaaaataacaacaaatttcaacccaaacacctgacacctgctttgctcattttgggaatgaaaatcagcaaaccactgtgttacttcctactcctcaaacaaaaattgaaaaaaaaaaaaaaaaaaaaaatatatatatatatatatatatatatatatatttaagctcttccagaaaagtgctgagctaaaacagcaagtccatatatattgttatcaccaagtccatactccagccgaatttaaattatatttcattttctttactgaaatgatcccttgattaaggattgggggcaggtatcataataaaatgagtaacaaaaaatatatatcatgaatcatgatatcagtaagtaagttatatatgctaaagaaatagaaatatataaaatagaaaatgcatggaagactttccaaactagaataaagactaatttgatgaaattatatattataatgattataggcacataccagatgagtgaggaggattcgggagtgtagagggaaacagagaggtaagaactgaaaattgcatttgggtgttggaattggaagctaggcatgatgcaaacgaaaccaaactaccaaagtgagattagattagaattagacagaaagagaataatctgtgcactacacgacacgaataccattatcattagtgggtgggtcctaccttcttgtcgttttctttgaccgcatgcatctatgatgttttcagtcacttcgtgtatcattatgccagattgccacgccccaactatattcttcacagtaattatattcaaataagaatttataaattatcatataaaataatagttcatactttttatcataattattttaaaatttataataacagtgatatttgataaagttaaatgattaataatatttaactttatcaatacataattataaaactctcaaataaaatataaatattaaatttaatattatttaacatgtgaattaatggacagaattattttaatttaattaaaaaattaaatttaaattttattatgcaattgcaattaaattaaatattcaaaaataattattaaattttatttaactcgaataaaattacttcctacaaataatactcataatattataaaaaaattacatcatcaatcaattagaaaattattataaatataactttttgagatacttattaaaaattaacaatttatcatgattgagtgttcacaaatcatgaaatattttggattcaatatggtttataaattataacttttatgtaataataatattttacttttagatcacattataattgatatttaaagttatatttactatcacccaactataattttatctaacatatttatcttggaaaaaaaaaaaaactctatctacctgaattaaatctgagtgtgttgttatggtttggtctaaacatgctaaaagttggtaatttgcggtgtacgttactttaaagtttaaacaaacaaaaggtcttaaagtcaaaatgatgcgcgctgcaagaaactgtgtgacactgtgtgtgtgtgttagtgggggcgcctcatattctaagcatcgccacacacgacaccacacaactcgtccctttcacgcgcttcacgatacttccattccacgtcttttcagttctcaagaatagtatctacaaagttagaaaaaaaaatagtaataagatatttggaataaatgatcaatttatccctaaaaaatagaaataacaaatttaatttataaatgtataaatattatgataaattggttccgtcattaagtcttttatgtttttgtcgatcctcgtgtacacgtgacaccttcatgaggtcaagtgataagacacgtcagatattcatcattttttactaaatagtcacctaatatttgacttctcaaaacatcctgttttggaccaaaatgacagttaatgtttggctcctcaaaacacacaccttcacaagtcaaacatttagtgacaaattagtccacctcgtgaactacacctacgtcatcggcatcatcgtcacataccaacacaactatgtcaatgtctttgagtgcaaccaggttgtctgcattgtcattacgacctatcgtgacgttgatgtcacgccagagaagcttagccgcaagtatgttgagatcttcatggcccctgacattgtcctccacagcgttagcaacacctgccttgtcaccatgcacaacaagagcatcgccaagataatccactctgccatcgacattgagaacaagatcctcgacgacgaaacctggccctccatcgaggtccattccctcaagcaccaagctagcatcgatgtcttctccaacgctgccttttaattaccgtaagagatactcaagggtagtgacgaggcaatgccaacctcgaccccgccaagccctaagtgacattttcgtccaaaacggtgtgcattagacgtgtcttgtcctttgaccttatggatgttggacttgaggaccaacagtggatgtgccacgttagttacatttgtgtcatgtgtgcacaaaggttaatggaaacagtaaagacttgatggtcggactaacttgtcacaacatttgtacatttgtggactaaattggttatttcatatttcaaggatcaaattatcataggatacatctttcagggaccaaattggtcatttacccatagatgtgggctttcttgtttcataactatttatgataggtaaaaatagtttttatagctttttgaaaataaatattttttaaggaaaatgttttctagacacctaatgattaatatgctacccaatatctagggagcgaaaaaaaatataggtatgataagatttatgatatcataaaaagatagagatgaagagaaattagaggtgttaatagagtgtttaaaattatgagtagttcatgtataactactcttttttttagggtaaatgaccaatttggtctatgtattttacactaattgtcaatttagttttgtactatgaaaatgatcaatttagtctacaatcatgtaaatttattgacaatttagtcctaccttcaagtctccttcatttctgttaacgtttttggcaatgtggcacatgaaagacgacgtgacaaatccatgtggtggaagtgaaagccatgtgttggaccaaattgtcaattggagtatgtgtgtgcttttgccttttattaattcaccatttatcctcttcctttttacattttgtaagaaaaaggttgaattatgggtgctaagtttgctatgctctttcttgcctttgcatcatcgatgcccatgacgacttggcgacagatggtggtgtttggttggcggttgccgtttttgtttgatttcttcttatgcgttgaagatgaaaggcaactccgtaaggaaagatgttttttttttttttttgctggactttattaatgacctccatttttgtaacatttctcatgtggccatcatttttgttagatttcttcctattttttcgttattgtaggcaaacaagggattaaacatgtgttagggtttagggtttgtcgatgatgctttgatgaactgaaacaatgatgctttgttttgggtatgaaaaagaataaatattattattgatacaaatatgctctgttttcttcttcttttgactctattttgtgtgtttccttttactgaatgtttgaaaagattaaccttatgttataccacaaaggtcgatttgttcaaaatgatgaaagggtgttggagtatgtacgtggagggtgaagaatgttattgggactctggagactgaccttatgtatgttttttactatctatgatacatgtgcgtctttaaattcacaatattgtcatgaaccattttgtcgttaagttatattcgttagggatcatgttgtcattccaaaagaaaatattatcatgaaattagaaagaagagtcatcgtgttcttaaaatagtcattacctttataaattttaaaataaaaaaatcactaacattttagtctaaaacattgtggttgatgtggagcatctcctatacatgtggatttgtcacgtcatcaaggatgtgttatgttgacactcaacattaacgaaaacggatgaaacttcacgataggattaaattgtcaatatatttacacgacgaatgtaaagtacacagacaaaattgatcatttatcatttttttatgatacgatggtagtttttattaattatttttaaaattaaaaagacaaacttatttttttcttcttattttttaacctcgaactgtttttttaataattggaattacaaattttggttctccaatggaatctcaaatatctatataagtttttgattttttaggataactatgaaattaattcttaattcaaaattgaaatttatttaaaaaattataaaagaatcaaataattccttgttttcagtttaagtctagttctgtattgtaaatccaaaggctcatgttgaatgagaatattttaagaattatttttctaccataatgtttttagaagattttcttatatgcaagtgtttttagaagttaatatcgcattcagtgaatcataatacagtgaatcataataggtcttatcttaatctcgtataccgaatatttaagaaagtataaataaaaatgagaatatagattaacaataaaataaaaaagttgtattaaaaaattataaattcatatttaagaaaaataataaataagaaaaagacaaaaattattttgacgaatcaattaatctcttactcatcacaactagttgattatctggagtgatctcgtcaaaataattaataaccatgaagttagacaatttttttttatatatatatgcactaatacacacaccttattcagtgattttgaagaaacattgtaaaaagtattatggtcaattaataaaaatgaaaactaaatttgtaaactaacttacatttttagaggattatatacgtctttggataattataatgtacaatttcttcttacaagctagctttaattatcatttatcttaatctatatatctaaatttgtccaatttagatgcattctatccaggtatattttatgtacaaatgtccagattgaatacatcttattcaactgcgaccaacctgcatgcgtcctgtcttagaccatttctttttaaggtctcgatcgagtacatctaaagtatctaatcaaggattaagctatgctttaaagagtaatcttagttcacttagatttttccgtgcatatattaatattaaaattatttctattaagtattgcagtgtatatttttaaaaacgaatttaactagaaacaaatatttaaaaataaaaagaatcaaagttattgagatagttaatggtgagtggtgtggtgactatcgatagttgtcaaaaacagtgataaacaacagcatcatattttttttcatgtatgagtttgtttattctttctcatgccttgtcttttattttcaatgaataaaattagatggagagaacaaatttaactttttattttatttaactataactaatattttaacttccacgatgcacaagacaaacgtttatttttataatatataagtaggttctctctctcttttttcttctcattttttaaattttacattatttttactttagtttttatttatatttgtagagagaaaatttataaacaacagcatcatattttctttcatgtatgagtttgtttattctttctcatgccttgtcttttattttcaatgaataaaattagatggagagaacaaatttatacgagaaaaaattaaattatacttttataaactactctaactcttgcaatgttttatatcgcttttataaacataattttttgtttaattatttaattatgtaattattggaaaataggagaataattgtgatgtgacaatagtatttgttttgaaagtaaattttggccttgatccagtttatttttcaaaatttacatagtcatgtatgtaggtttgtgaatttaaagaaaaaaagatgtaaaaatctcataaataatgctcaaaagattcaagatgataagaggaggataaaaaaatgtttttttactctcaaaattgaagttgtcaatccttataaattattttaactactgataagttcttttaaaaaaactatttcattttaatttaaaataatattataataggatttgttgaaattgataaacaactaggaaagtaaagtatatataaataggacaatagttgtttgagataactttttagagatagtatgtaaaatgcacatttaaagaagcgcaatttttttatattaatttcattctttaaaattaaatttgttgcatatatagttggtaaaaaaaaatcaaattcaacaaattttatttttattaataactatgggtactaacccataggctaatgcatgctctcctattctaaaatgtatcaaacttatcttgtaattgggtctcttgtagtggactttattataggtattcttgattatcatggactttcaacgttttaagtcaaagtagatcgccttagtgatgtaagcctctaaaatttactctattttttatattaaatttaaaattgtaatcatatatgataattgtaattaaataataatgtaaaatatttttacattattagtgtattctaattattttaaaaaaattataaaagttgcaactaataaataacaaatatattaacttaaaaattaataataataataaaaaactagcaaaaaaccacaaaccaggcattaattgcgatttcgaattccctccccaatcaaaatagttattcctttcttctaattgcttccttgttgcctccctcaccatcataacttaattgtatgccatggcctaatttgattgatgaatgaatcaatggatggagttggactcatatcgaagcatctctcagtgaacttgtaggcaattatttagtttcaaattaagtaagtaatcatcaaatatttaggaaaagtaaatacaatgtttaaatattttgaagtgtctcaaaggacaaaacattttcatacgaagaacactgatatactattaaacaacaaatacgaacacccataaaaatttgatgactgaggggtttaattttacgcatgaaaagataaatatgttcttttcttcgaaaaaaagataaaaatgttcattgctcaagtatatgtttttatctgtaaacattaaagacattgtcaaaaaatttacaacaattcatgttattgtttaaccaactgagctagactctctccacactaagtgtatatttgaatatgtattcctataatttattttgaatcaatgtaattttctaaaattgattcaaagtaatttacagtgatatgattttttttttttggataaaagatatttaaaaagagactttaatacacaatgttttgtttgaaaacttgtactactaattaagattgattttgagtatgtaattataaaaaaaaattaagtctaattaaaggtatatttagaacagatgacataattaagaatatactttagacaaatatcgtgactcgaattagtattaatgtaaaaatatttctttaatacttttaatgagacttgagtctaaaatttataatcatatttttaatacaatgtcaaatatcatggtaaataaaaaaaatatctgactcattatatattcaagttaaggcatgtcaaccaagaattcaaatacagtcaagagtacttgttttaatatctttcttgataccttatattatcgttcattttttttactaatgtttcaccttttgtttggatgagaaaaaattaaacgaggaagaatagaaactttcaacatttgaatgagaataatttgttacttgtttttcttcctatttttcagatacataatttttttttattccctatttttcagctctaagaaggatgttttatagcaccaaaaagaaagaaagaaaattcactctatttctcgtgataaaatagtttcaaatagttgaataattaatgagggtggtgagtgtgttttgttttagagaggttgagatttgtgttttcagagaattatgaaaattgaattaaaacaagagacatatgtattgtaagttgataagaattggattaaaataagagacacacaaattataagttcatggtcaatgcaagatgtaaggagttgtcgatcggcagcaaattattatacaaaaaagattatgtcgtatgcaaaattaattataggtcaaattattatctgtttctttgtcatttttcatcttttttacacggaaagaaatgtgattgaggccgccactttattttaatttattttcaccatatttcataaatattaaattgacttttgttgttatatttcatttttaggcctctttctcgttgtttcttttgccatttccttgccaaacactgagaaaaagtgactctaaattaatagtaaaactctagaaatgaaagtattaaaagaatattgactcttattgttctctcctatatcacacctctttcttaccgtttctttgtcatttgttcgtcagcaagtagaaagtgaaagtgaatataatttcataaaactcaagaaatgaaaatattaaaagaaagaaagaaaattatatttaattttgctagtctatctgttgttgttacatctctttctcattatttctttataatctctgcccccatgaaatatgaagcaaaagtaaatctaaattagtagaactcaaaaaatgaaagtattagaagaaaagaagaaaaacaatttttcttctgttattttctcctatctgtacacatctttttaaaaaaaaggaagaaccataaagattaagtagtaattgaaatttgagtttctcctaaggtagtacttattatttaatgtataatgtcacatgatttatgatttagttctttttcttattatttaagtggacctgaaaaccatgaaaaataacgcgttaattgtatataaaaaaaaaagaaaacaacgtaagtaatttggaaactatttataataatatatttttaaaaaaaagaagtgatattataatggtagaaagcgcgtggattggtgggtgatcgcgtatggtggattgtttgtggtcttatggtcttacagcagaatctttgtttcatataagtagacgagcgtgggcatataacactacaaatctaacattagcatttaacaaatactaccatacaatatacattatacgccccctttaactatactatcatttaaatacatacatcgcttaaccttcggcgcagcacccaccagcaaggcaacacacacaattcgcaatcactttttttttttaatttttttttaagatgaaaataatatgcatggaaagaaaagaataaagcgcaagagttgattagcaataataaaataattaatcagcgaaaatcaattacagtaacaagcaccaacattaacattataataaaacatgagtgttaattaaataattaataaaatattctctcaccttcgtttcttctgtatctgtcgtctctctctctctctctcatacgtccctatcagtcataaattagggaaaagcaagcagacagctacacacaacactctctcctattcctcctccttcttctcttctggtgtgagagcgcaaaacgttgattactctctctctctctctcatctaatcataatcatcgatgttcctcttttctcagtcttcttcttcttcttcttcttcatagtctctcccttcttgtaatcacttatcatggcggctacgtttgatggattctccataaggtatatctatttttctattatctattgtttgtggatttggttttactaatatatagaagcgcgctttataggttttgattcggtgttgctgttgcagggactacacatccaagatgaggtccatcgacgttttcaagtgctggccgttcgcatccacctcctcacgtgacgtatcaccagaggaggttcagtcgtggcttccgccgatgaacctgtgccctagatccggcgattccaacgaacgccgcgttcaaaatccggagattccgccttctgctccggaagtttctagaaccgatgacgacgacggcgacagagattgcagcgaagatgaatctgcagaatctatggaatccgagaaatccgcgcctccttccgactcctcggcggcgaacaacaataacaacaacgaagacgagaaactggagatggtttgtccggtgtgccgcgaattcaacgccgcgacgctcacggcggtgaacgcgcacatcgacggatgcctcgcgcagacgatgagagaggagcgtcgccacatgaggattatgaatttgaaatcttcgtcgtcaaagtcgaagccgccgaagaagcgttccatagccgagattttcaaggtggaggagcagccacatccgccacagccacagccacagccacagccgcagcctcagccaccgccgcaaatcgagagggtgttgaagttctggccgttccgcgagggcgaggcggacgatgtttcgattaccgttacgaagttcgagtggctttctcggcggctggaggcgctgagatccacgcgcggaggcggcgagtcggcgaaatcggaccaaggagattcctcggaggagaagatggagatggtgtgtcctgtttgtcgagatttcaacgccgccacggtgacggcagtaaacgcacacatagacggttgcctcgcgcaggccgtcagggaggaacggcggcagatgagaaggtcgacggttaattgcaagcccatacctaaggcgccgaagaagcgctcgatcgcggagattcttacggtggcgccaccgatcgaagccggcaaaaggaaagcgattcaggttgaggaagaagatgaggagaaatccgattatggctattcaggtggagattcaactagtgccgccactcctgctgctgttgctactcccgttgcttcggtaattaagaacaagaagagtacgatgaagaatagaaacaagaaaaagttgaagaaggtgaagaagaagaaaaacaaggtggagaagcacggcgatagtggtgtgtggttcgtgaacaatgagaagcagacggttgcgagcaagaagaagaagaagaaaaaaaagaatgtcttcaacaacggaccaactgggaacaaggtatgtggtttgtgtctcataaaatataagttaatcttccgttatttgctgtgtgtttccgcgatttgcagctaattcctggcagataagtatacaaattcatggaatttgcgcataaaatattacccgacactgtagaatgtagattttgggttgatgtagtttcttatgccatgggattatagctttccttactctatgtcttgctttttctgcataaaattactgctgaaaaagctgattagagagagagcttcacatatttgtggacgaaagtgagtgtttttcttttggttgagtacttgagcgaaatacgcgacaagtaaaagttgggaaaagagagttacgaaaaaaggaaaactgtgaccagtgccttcgtgcgcggaagggattcagaaggtagtgaagcctgcaagaatgttgctccagctgtagtgtgtgttgtgtgtataatcagtacaagtaccctagctagaaggggccactcatgggttacgaggtagaagagagagctgagtctaatgatgaggggtttctctagccccgtcactattaactaataatttgggggggaattatcgtatgtgccatgggtagatcaacagattctcatgtatctcttgtggccagtttttcggacgtagagaggttttatacgcagcttacagctggatgtattttggcttgtgggagatctgcaagtggaggtccagaatttgatagatcatttattgggtctgtcagaagtgtatatttagtgatttggattgatgaatgttcgcatatgcaatttccagatgggcatgtatcgtcaaaaaagaatactctgacttgggttgatatagatcattatcgcatgggcatattttatggcgtattagtgaagtagggggtggtgatttatggtacgtataatggttttggactttctgtcgttgtgtgagacacctgattttatattgtgaaagtgttcgtttttgggtagaatgacttggatgtatcggtcaacataagttagcgactcatgttttgaacatgtgcagacaattttgagataagatctaatcgatgtgagtgtctattagaacccaacctaggaggtgtatatagaagcaatagaaaaccgaaaccaacgtcagtttgtggttacgctggccgaaatttgaaagtggaagtaaagtagtcaaatatttaacttggctagccatgaaggttactcgatgatgatataaggatgatatgatcttgcagccaactctatccttagaagtgaaatttataacttgactgtccttactgtatcagtaatggcatcttattatagtgtctagattgttttaaataacgtttctagactaatcttagtaaatactttattatccaaaaataattctcgaactctggttctatatttttcctacctaccatttcttttacaagattaaaatatattggattttttcggcattcagattctaaagaaatctcaggtttcgaatggggttatctggaccacgtagatttctacagaggtgtatcatatgtgatatgtgcatttctagtttcaacagtgaacaattacatagcagtctcaaattcatgtaaaaaaattatttaagcatcatgattcatgcatttgccattgtccatcccctccccttttaatagaatccaatatcccactaatttttaaaatttaatttaattaatttgcattttaaattgcctttctaaaagaacgaactaagtaagatatttatcgtataaatattttacaataataattttaacctcatggtgatatcgtttaatttcagaatctgtaatagttgtttgtcctaatactatttgctacatccatgcatgtgtttttcgttagcttcttcttcgtataaacaatgataagaatatatatgttgttatagaattacactttggatatgatattttagattcgcaaagtggcattgtagaaggtagaaattttgttacaaaaagggttgtctttacaattttgtttattttatcataaagtgtaattgcaccttaccggatttttaatatcttaatagcatataattattttacgccccagctttcagttacaacgaaattaaaaaaaaaataatattcgttccaaattctacaagcttgtttagcgttctgtttgttaagtaaaatcaattttagggatttgtactttctatcaacacgtaaaaattatcaataaataagattttgaattgaagctctcatgcattcttcatgctgatattcatatatataattatacattcatctagcttgatatatggttatttcatgtatattcactcgtaaagatttaaaaatagtagtatatttgtaccagaatatataagctcaaataaccttgtatttattaactacgagcatttctgggatgtattgattacaaaaaatttcaattgtttttcttagtacctaagtttattttatggctacttaaatatatgatctacgcatttatgatatatacatatatagatttctatgtttcccttttctgaaaattgatactaaaatgaccaagtttaagaattttgttttaagcgtttctgaaatttcttatcatgataaaataatgatataatttcgttcttaattcaattgtttcaattttataaacttctacatgtagttgatcttaatgtatttcaatttgatttgtttttaaatgaatgatggagtacttaaaaccccaattaaagtgttattcaaatgtcactaaagtcttttcctaattatagaaaattaaaaaaatttcacttaataatcaaagagtttctttatccagaagtttggatcgtgattttataattaacgctggaaatatagtttgtatagttccctgaaactttccatggtgaaattgttcttttgtattaaatctacttttacttgaccataaattccatttgaaaacgtctttgccgttttatcttatgtagacacaagatataggcatgaacgaagttgcctcaatctttcacaaaaagctttttgatgagggacaagaattataaaaaaaactgaaaaaccaatggtctgagtaaacttttagggacattcatctttggacatcaagttattgtaaattgtaatgtagcaacagtcatagacaattgaaatcctttcactatttctgattggaattgttgaaaggatatgaaatgctaattttctacagtgtctgtttcataaacagacattttggcatcattatacatgaaactgttgtaattttgtttattttcttgtaaaaacacaacatgacatccataaaaaagaaaagaaaggagaaagatataaaagctacaggctacaagaggtgttattatatttatcttcatattttgcatatcctaaaggttagtcggcttattcttattttattataatataacattcataattttattaatcttgtctatctcaggatgatgtttacgatcgcatggtgcgaagtgcagtaaacagttccagaaaactaaaaggtacaatcggtaataaaatgcttccacttcatgaggttgatccttctatcgatagaaagaaatcaggtataaattgcttatcggtaaaaaagaagcaacaagttaaaaactgggactcagttggaaagcaagaaaaagcagtatctccttttcatggcattcttaagaaccgcttcaaacatgtttctgaaaagacgtcaagtggcagtagtattggagatggtgctcaagaaagctattataatgatcaagaggcaacctcggacagacatgtgaaattctctggcaaagatgatatacttggtccaaaaaagacaaattcatttgatgaaaccatgttcaagatatcttcagatgcggtggcatcttcagtagtaaaggagaaggcctctggaagtgatgaagaaactgcaagtttggagccaaacagaaattatgaccatattgacagaggcaagagagaggaggtttgccctatagttgaaagtaaacagttttctaacactctggaccaagataccgtacaaagcttcttgaagccatgtatcaatcaagagaagtcaaaacagttagaagagaagtcagaattgttgactaaggtggcagtttgtgacaataatgattcacagtttttttaccgagggaacagaaataccctgcattgttctccgtatgctgacatttctagacctctttcagcagtccaagaagagcagatgtctggtataaatacacagatgtgtgaatctggatctttcagctacagtgggaagttcaaccacttggatgatccacaggttgatgctgttaactcaaatgaaaatacaaagacatttctggagccttcttcatcttattctgcttcatataatgcaaatgaaaaaccagaatcttcattgcaaacttatggagataaagataacagtggcgaggccttgggtaggcaattttctcgtatgttttctgcagatatgattgataactcattccccaatacaggctgggagaaaggaagtggcaaaaatagctgtttggatccggatttttttggtttgccactcaattctcatggtgacctaatcaatttcagttcaagtggaaacttagggatgaaccagtcagatacatcaagtacgttacgtggttcttttagtggcttacccattaataatattctccatcaaagtaaccaggaaaatttaagcattaatgagaatcatgttgttcagaagacatttccaaaagatagtcttaatccatttcctcatcatccaacccaattacctgtcactgagttacaatctagagagagagaagatatcaaccgacctaattcttcagatatgtgttccagtcactatgtcccgccacttaattcagagttgaactgtaagaaaaactcgttcattgaacagaatcaatgtgaccgggtctggaatcacaatggaaatggggtgatttctctgaaagaaggttcagatcatatctcaccaagttccagccaactaacaatgaggttgatgggtaaagatgttccaattggtagaagcagccaagagatgcaacaatttgcagatgtttggcctgatgaggaatccagaagaaggaattattctgaatatgctgctttagatcactctttattggaaagaagttctaagcaggaatgggtatctggttcacctatacaaatatcagctgacaatgtattgcaagcagcaaaaattcaaagcaatcaagcagcacaaggcaccatattgatgagcagtacagactctggattctctcaacagtttattggtcggcaaagtaatcatggagtcaacttcaatgccagttcttatttcaatcccattactcaaaagtctacttatgcagtatttaatggtgcatccaatgacttttcagagcagtttatacctggagctaaacctctaggaactggcaattttagtcactcgactcatgtagccaatggtgagctgaatgacaggaacaaaaatccccatgttacaaaatcagcctttggaggatttcctttcttgcagccaactgtgaatgaacaggccaaaacatcttggtttgatagtccctacagaagttcaccatcgtggttgtcaatctcaacagatgaaatgctaccagggatcttttctcggcaattttctgcttcaagtagtcaaaattttcctcaaaatctgtggggaaataatttcactacgccatttgtgaatcattcagcagaagttcgctttccttctaatcatctgacttcttctctaggtcccatgcagacgactcctctttctccagtatcaattggtcatccactacatgttccggttacaccctctaccataaatagtggtaatataaacataaataaggtcgctgacagattgaagtttgatgaccatcagctgtgcacaaataccagaaagagacctgcagctgcagccaatcttgatgattccagaaaacctaccaagttaccgaatatacgagtgcaagaaaacttcagtcgtatgactaggttgcctggagaaaagtcaagcgtggaattgcaacgaaacacaagagcacttgaactggatccgcacatgggcagtgctaggagtaggtgttgtcagcatgaggcacaaaatctaaatcctggaagttatcctgctgtaaattcttttaaactggacggcatggtaacatcaggtcctgtccgacttggtcctaaaagagcgaagcacatcttaaattcctcttaaaatatggatcaggatgacaagctattctgccatattctcacctgcgattactgacagtgttagtgatatagaaattcagagaaaattgactaaagtatactgattttaggtgtaagttatatcattttatcatatctgcttttcctcctccatagtatatatccatttgagaacataacaggattgtccatgtatcaatattgccaggttgctgaaaccggtggaaaaattgatataattccatccagtctttcgatacatccagctctcagttttgaagtttatgccctttacagaattttgtctccaatgaataatgacgctttggatatctatttttgagccaggtattccccacatggcatctgttcaatgactatgcaaagatgtgcttattactgatacaccagaaaggaaagaaagatgggctttaggataagggaatagtccatctctcttaacctattcaataaaacttgaatttggggctttagttattcattaaccattggatacttcctcattaatttgaactggcaaattatgaagaaaaaaaaattctaccataccggctttgattatttatgaaaaaattattatttttcatttaaaaacttctaaaaaaaatatgattacaagctgcttgaatataaaaggttaatccagtgaagttgcttttgatggaaaaatagtttaaatttgttttcatgtcttaagttgtgagagaatttaaactgaattacgtttttgtaattgttttaatatattaaataaatcaatttgactaatttattccaaggtcaattactaaggagatgttacattgatgaatttattaaatttaaacggatttcatattcatttgagtcaaaatgagctaatgatgtgtcagatattctttaattgccggtacactaacgcttattattttattaatgcaacacgaaataaacacaaaattttatcaaaatccaacaaaaaagttagtaggcaaagtattgcagtcgatcctcctgtttgattctctgtcttgtagatcatacttctccaagtattgtatcggccaaacttttttgtattttaaacttaattatgtattgccgaggtggaagtgatgctaataagtaatagaaaataataaccaacagcatctctgtatgaaaagtgaaaataaggagggggtgaagttgttacgttttagaatgtttccacatataaaatcggaagagtctaggataattcatcatacgagtgcatgattttatgtttcaatttttgttttcttcctgattttaattattatctgttaaaaaccttcattcaacacagtatcagttactatatagtgtatatgcataaaaaaagttacaatatagtgtatatgcataaaaaagttactatatagtgtatgccaaagtgttgaaggaaaaaggttgatcgaactggttttattctattataagattgggtttccgccactttaatttatacataatgactattacgtacgttgctttgtttgaagatgagtattacccaataaaggttgcttatgaaagcattatggtttttgagatcgtcaagcttttccattatttttatcccaattaagcatgagtttgtgggtacgtgtagttaatagttatgctgaaggaacttagaggaaaccaattagtaacttgcagtagaattctcgttaaagggtttaaaggatttagcgaaaaactgaggtaatttaaccaaataatttttgtttcttaactaaatcagaaaatgactatatcaaactagatcgaatgctcttacgtacattcttaaaccatggaaggtacacataaaatatatgaaggatataatcgctgccatttagtttaattaaacaatagattcctccgtctccttcatgttaaaatatacaaagaaagaagtatcgatttcacaatgttgacgttcgtttcattccaacttggtcaaattgatagtccctcactcatcgcttctttgcttctttttcagcctgcacatatgaaagttaacaaaaaattgttaaaaacacagatatatagatgagctttacgatgaagcaattcatagttgttttgtatcataccgctctgactactctatcaaaggcatcagggccatatctatcgttatagcgttcaactgctttccttgcatcgaaggtcatcatgtgaaggaccttcttgtactcctcagaataattggaacttccaatattctttatgtattgcctcacgtaattctcatatatgtaagccgctccattgaacattggaagtaccaaccagacgcaaaacataagcttcaggtatccccaaatgggaaacctgtatatatttttatgccaaagttcaaatattaaattactattatgtgcctctatatatatagtttgatttgacttgaaattgatgtcaacgtaccaagcaaggatcttatgagtggaaagctcaaagagggtcatgaaggagtataaaacccaatacgttagccactgttgatcatccaaggttgaaggactttcaattgctctcattgatgcgtatctatgatatttactcagaagtagtcaagaatttgatgattagtcatatcatgaaataattaatacagataagataatgtgcatgcatgcctctgcgtaggatgcttaattaatttctttttattgattgttaattaagaattacagcagttaatccggaggaagagaaaataatgatacacgattgcatgataatatgatatggcatttactatacttacagaggataaagaagcatcactccaggcctggcatgcagaaaacaaaaaaaaaaggctgttaattattacggggaaaaccataaaatgaaaaacctatagttacagttgtgtgttaaattgcagaatacatattatggtgaatatttttttattaaatgagcattgtacatgggatttagcaggtattgtgtgaaaagtatatattctgtaaggcgcagatataatatagcaatgcatgtgtaggagtggaatgaaataaaatatatatacgacacaaattacagatatttttaaaagcaaattaatggagagagattaatttgttcaccctattattgtgtccaaatgtcttgccattgttccaaggacacccatgatgtagaaactgcgatattcagatatttcctggtggggaaattcaagttttaagaagatttgaaggaatatgggtggtattgttgatgcatgcaaatatgtatatatttagtgtagtagcaggtgaatgaaggaaaggaaaggaatgtttgttgaatgacccaaaagtcttctttttctctcaagagaggaaagagaccataaagattaaggtatactatatgtgtaacaaaacgggaggggaatataaggatgccaaaactttgggatttcatgtgcctttggtgcatattcgagagttatcgtattaccttttgagctctaagcttttgtcattgtggcattaaatgttaccaaggtgcctaccctttcaattgtttttcccagtctcggtagagttgcgtaaaaagttctactactacggccttaagcctttagtatataggacaaaatagtacccatcaaattcaatttaattgaaaccctacattaatagtattagggtcccgagagaatctactttttctctcttcttcttaattttctgaaatatgtgtctatgtatacatgattttaatttcctctttagtgtaatatcagtataaaaaagttttgtgcttgtacttaatgttgtcctgtcacattatttaatacaatttgctatctcttcggtttattaatatagtacgtcaaatgttaaaataagatttcaagcaaacaaataaaatgttaaaataagattgaacgatatcaagaaagtgctttgagtcactagatcttgttagtgaaaaggagtttgaataatttgtagaaggtgacaaattcaaatttcattattatcattatacgaaaattatcttttattaaaaaatatatacaactatctaatgggaaagtgagaaatgagaggtaacatgttgaccataaatatatagtaggtggttaggattatttgacttaaatttaatcttgataatccattttaataatggtcagaattaaattctttcacggtatcatgattttttattttatttttttggtatggtttccagcttattgcattcaatacctctttttgaatgctaatttcattattataaattgatcttattaaacacgtcaagtttataaaaaaaattgcacaatttaaaaatgaactaatacttaatcaaaaaatttcatttaaactataatattttttttaaatataaataaatactataatattgtatatatatgaatttttaataattgaatttatcaaattcataacaaaaaaattgtgtaatagagcaagggtattggacttttgtcataaatgatcccaacaacttgtatctatgtaaaacattttctatatagataagaaaaaaagggagaaaaaaagttaaagtgtattgaaatttcatgtttgaataaagttaatacgttattagtaatttttatccactcacggttccattaaaaaaacaaagattaggcactgatcatttgatcatcggattgactctaattttacaaaattaacttcgtatagaatcaggcaagacgatttaatatcactaaaaggaaaataacacacctatacatctatgaaaaaaattttctcaaatgcaatcatgaacataatattgtatcccatttgcttgctacttgctacttgttatttcaagggtaaaaattccaatacatctgtttttctcttttccctaaagtgatgacatgaattgtacactcccgtttttctcttttgcctaatagagcccgatcaatacaagttacagttagtacattttacacacacacaaattccaaaagattcaatcagaaaaaagtgaagcggtgattccaaaattaagaaaatctaagctgattcaagcaatatggccagccaaagtaattaagaatcttgacatgcttcttctgcccaaaaactctagtcccgatgggttggccttgcttgtccacaagcaccacagcattgtcatcaaacttgacctcactttcatcacaccttccccttttgcatgcatggccgcacgcacaaccacaccatacactaccttttctttcttcacttttccattcggatgtgcctccttcactgatgttattatggtgtcacctaaccttgccctcttcttccctttcaattcttgaatgcacatcgctcatgagttatcaaccaccttcagaaccgttcccatctgtatgaacttgcgttgctgttgctgctaaagcaaaacaatttttttcattagtcagtcagtcattaatccatgtctggcatctttgcattacaaggttgtctacaacgtcaaatgactaagtttagcaaaggtaagaaaaataaataacatgtcattgaaaataggacaaaacttacatatatagttccttagatattgttcgcgatgcactgttctcccattagaattggagttttatcttgataatccgtgtaatcctttaatgcaaaacttactactagtagattacggaagtgaaactgattctaattgaatgacagcataaaaaagtaaaacacctaaaaaacttgacaagtattgtccttaaaaatatcactcatgatcacaattttcacaactatgatattgccataattcataaactgacctgagataagaaattgctggatgctatctcatgcgatgttaataaaccatagaagttgttattccttaatccaccaagcaaagaacggtccactagtttggttttcagcacatgaatgaaaccaaagcaagttaattactacttcaccatgcaaaaatcacctcatcaacatggaatataggagtaaattttttagagttataataattattagattttaagaaactaaatgattagaataaaaaataattcttttaaaattatttttataataacttgatatctcctttttccttccccactctctctatatataagtggattccctcccaccatatatatcatgtcaataaaaatgttaggggatctatccatgacataatgaatgcaatgcatactttggcctaccgatttacacaaagcttaattaatatgtgaaatttcacaacttcagattgactattataaagcgcaattttttcatcagaaaaaaaagagagctcaatagctatatactgaaggcttttatgaaaaacaaggagcaaacacaggggatgaagcagaataaaaaagtaaggacttacgaagagtgcatcttgaagtaagggttgcagcatggttgaaaacctgctcattattgggcctccattttttggtttcagagcataatattattgggccacttaaatctagcccatactcttataaacaatgcaaaagaagccctttagccaacacatttaattcacatcaattttactcactctactccttatcataagagatactttaagaaaaaatgaatgatactttttataagagattttagaatttttataaaatatttaatttttctttcattggttgatcttatcaaatattctaattatgagtcttgttaattagtgttcttgtaacattgattaataaattaaaatgagtaagtatttattacgtaaaacataggatatcattttattttattttagttttttaaccaatattccaaagacatatgtttaatatttgtcttttaagtatttatgttttttattgatagtgatttataatactctagcattttaatcttttcacatcacccataacaagttaatgattgttaataaggacataattgacacattagtagtattttttttatataaattcaatagaatcaattgaattaattaattttattggtttgtataattgatgtccaaaatgttttatagtaacaaggaccagatggagtattgtttaaatatttaaatatcaaacaagtattatgaagataaaagaagtttatttccgtttcttgaaattatttgataaacatataaatttaatagtaaattatactggtatatttttaataaatcatttttgttgtgtgtatccatagaacattagaaatagagcaaaatttgtcaatacaaatttgttcgttgtatgtagtttgatttgtagattattatggatctttccgtgttgacagtcaaacatatcctattaaggttgattaattgattttttttttaaagatcacgaaaatatctttggtcgtgaccaatgacgataagctacacaaagaaaaaatgagggattggatagaaaaagttatttattttcctttccttttatgatcccaaccaacaaaaagaaagaagaatgagggttgcaatgttgcaagtatacccccaactaattccatggtcaatcaattcaaagcaaatgcaaaaggataatatttaaatgacgttaacaagttgtttcgtctcgcacgtacacggtacacatttttttgtttcctacaaaatcattccacccatgccagagtgttgatttctttgtaatgagattttcaacaattaattaattctcctgcttcaactccttacgttgtatttttgagtcgtggtccctcacctaatcaatcatcaattggctactagtgttttaggaattttgacttgtgcttcacaaatcatagctgttaactatgatcacaatattgctgttgtggtgtggtccatacatcatgtattcattggcatgactatgaattaccggagtagacgatgtagggcaattggaagacaacaaattcgggtaaagcattttttttctgacttacttttactagccattcttaacatattatcctatttttctttgtcaactttgttttctccattgggctttcagacgcatatgtgcctcttctgttcgggatacaattttattgttgtgccccgtttccattttactaactttcatcgatagttccaaagtttttccctactatatatcctctcttagaaccttcagtgatatggttctctcagttctattacttctattattatcattataggattttactgttcttatatttgaatagtaagtagtccactagttacatgttttacttgtatttgttattataatatttttaattgtggatttctcggcggcagcttagacaccataacattccattggttataaccttccgtgtgtagttctttccgaaacttcgataatttgttttgattgctttgaggatcaatgattgtccctataaatcaacacaaaatttttctgcacgctttgtcctcactacaacgttttccgaaaaacttcttaaaatgtcatttcttttataactatttcaagtcaaacacatttaactgtgaaattcttaagtgacaaactactaaaaaataaatatatcttgttggaatagacaatatcaattaatttctttaagtcatcatcagctgtataatctcatatgcacaacatttggatctatctcattttgatgtgattcgataagagtgttacaattttagtccttttagtcgattctaacttatttgtaatccacttagaagtagcctgctcaattatcattgtcctgctgcaactatatatgcatgatgaaatttgtaaaagaagttcaagttttttggtgtactcaaatagtcaaataaaagcaacaacctcatttctggcaaaacttgtataattgtattgaggcagcatatctagcatgttcaatcctcaattgtcttaaatttaaaaatccacaatcatcattaagattgaatctactccgtaagcgctgactttaaaaaaaattgtgtgataaaatttaccgatgatgatcaaattattcctctgtggctctgtccattaacttcttatttggtgagcagtttgttgaatgtattattcaacgtacaagaagtaactagttttttggccagaaaattgtcaaaggcatttgagtcaactacattccccattcacattgaagcaagattttggtatacatccaatacaatgtatggatggttactgaaataatgtgaggctttgcaaggaaataactagcatctctaggaatcagtgttcaacgcaagtaaaccattttcagcacatgaaagattctcagcaatcatagttgaagtgtagaaatgacgtgtatgtgtttcaattcttgttcttgtcctacattcttcactctgtcccacctcaaaaaaatccttgatcctgatcttttttctttttctaatgcgagtataaagaattggttttcatgtcgtcatcaatccataaaagataatacttggtcggaaaaatatccatggagacttgagtcataattgacacctaaaaagaaaattagagaacagagagaaaggcgtaaatactattgttgtttatgtttagacacccactatattcaagcgtctctcatttttgtcacatcttatcactaattatttatctttcttcttttcctaggttatcactaattcagtcgtaagggataccaaatgttaatttactttatcaaacattattacttgctcgtagctaacatgagaaaatacttggggtaatttttcacgttaaaaactactgcgtgcatggtcttaccttctaactaatttaatcaccaagtgtttatgctttcatagaccttctgatttatattagcaagtattggaaattatttttctctgggaaatacctgttaattgtcgtagttgtaagtgttgaatggtcatataaatgcataacaactaactttaattagctctcatgtgatcgatcagaagttgtcaagaaaaagatgattgtatgcccaaatttcagacaccatgattatgagtaggtatgaaggaataattgcacttatcaatgggttattatcaaaaccctttccatgttagaacaacgtggtccttaaagaagaaacttcaaggattcaaatttccttttatgatgttaggtcacgtacgtaggaggctaggacatagaatgtagccttaatattggcattaaattgttcagaacagatggcatatgcatggggaaatttgaatttgtaaggttcaacaaaacaatggtatagaattaaatatatgttgctagagaatgaaatctaaataatggctagggaccattcacactgcagctaactaaatcgatgaatatgcatgcctatgaaattattagatggcactagttactggcaagctataggcgttcccgcaatacaatattagtttacattgtacctaaaagaaactcattattgcattaccaaaacttctactcgagtgtttcgttcacactattgtgatttgagttcgatcatcagatttttattagtaagcgatgtgtatggttgtagtttaacaggtctttttttttttttgtgaaataaaaggaattgtagtttaacaggtcttaagacatgtacagttttctttatggttgcatggttctgtttggaaggtaccactggtacccttttagtataataataaatttttcctttggctgataaaaaaaaggatgtgtaaattttagtataaattctcgctgacattaatatagtctttggcaattaaggagatgcgtttttccttaattaatctaatttttttatgagaaaaaaaagaaggaactcattgcatttgataaaatacatagggcattaggaattgagaaagatttcctttgtctggtccgcatcttcagtggattttacatgagacaaatttgatgatacattttcgatcatcttatactcacgaatcaatggcagcaggcagacagaagaaaagttgggaaatatagataattaattactatgcttattttctttgagcaaattatattgcctactctttctttgagttacttctatagcatactaccaaatgcaagtagcactggtagataacttttatcattcatatctcaacgatgtgcttatttagttatgttattgaaattaatttccatcggctcttttacttttccatggtatttgatatcatatctgaaacagaaattgtttgcaaagagggtcctaatttattcatcagtgaatgaattagatggtgttgcaaaatcgttttcttttttctttgtgaaaggcatttgagtaagactaaccaaagtagttcaaactaatgaagagttttttttcttcttctacttcttttatctgtgcttttaattttcaaactgtccaattcaaaaatggtgagaatatattaattgtatatatatgcattgagtgtagcacaattcacaacataagctaaattgtggagaaggatataaatttaatgcttacataatatattaaggaataatgaattttaagtgcgactaaatgttatatcaaatgattacatttattattgttaataaaaaaatattaattgtatatatgtacatgaaaagatatatatatatatatataatgaatgataaatgcgcaattttatttgcgaagtcatattctcgttgaaggatgctaatagcttgtaatatctgcctgcatatgaagatatatattagcttgtaatgaagatgtaatcatttctatacctaatagagttttgggagcaaggatgaacagtatatccatttttttaaaccgccgtaattaaattatttttactttgtaatgaaacattctcaccaggtttggtccttttaataatttattcatatttaaattcttttttatgtacaaaaatttaaacttaataataacttatacaattacccgaacatatatatcatctaaaccactgtcttatctgagagtaaaacatacaaattattatagagcataattatcgtcttacccagtatatttcttctaactagaatatgtgttcacgttatctgtttcatcaacatggttgacgaaccatactactgcattgtagagggctttaattaatagattacacactgttattaaggatggaaataggccaggccgtctatcaggggtctttggcctggctgtttaaggcctggcctgtttattataaaggctaggcttaggctttttgaaaagcctatttaaataaaaaggccgggctcaagctttaaaaaaagcctattaggcctatcaggctggcctatatatatatatatatatatataatatatatatatatatagatagatagatagatattaaaattaaaaagatataaatcaatcttttaaaaaaagaaataaaataagataagataaaatctaaatagtctatcttacttaaaagataaaaaataaaatagaaaatttgaaatctttgtagtaggtttgtataaaagtcaatatatatatatatatatatattaaaactaaaaaaatataaatcaatctttaaataaaaagaaataaaataagataaatacttaatctcatattagagtgctctaattaattttaatttttttcatgcacaaattaaaagggaagtatgtcaatatgtgtctttctttatattaattttaaaaaaatattatgcgaattctcaaagtttcactaatatataatatttattgtaaaataggctttttaataggctcgtaggccaagccaggcttttaaataggctagatcaggcctaaaaaaaaagcctatgacaggtaaataggctaggccagacttaatgtttttaaataaggtcaaggaatattggaatgcatgcatattttctttttttatacacacaagaataattaagagatgccttagcatctcatactgataaagaataactgtgtatattaagattaactgtgtataaaagacacaaccaaacaaccaacattattaatagattaaatatcacttttggttcttaatttatcttttttttattcaatttgattttcttcatcttttaaaatattcattttaatcttttatattttaaatttattcattctaacccttttttcaatgtagatttaacattgttaataattttaagatattgagtattaaaaatcgtcataaaacaaatttttcttcttctaaaatatctccataacctaataacacataatgattgcttttaattcacgcactctattttatttctattattgtgtattgaattatgctgtcttatagaacaattaacaacttatatatttttattttagtttatagtgattaaaaaaatatgttattaatttgtttgtaaaagttaatttactttgaataattttattttttaattatattttagaagagttagaacttgtttgggtatgttcttttagtaacacttataagataagaaaataagaagaaaaaaataaaataatttctctataagttaaaataaattttctattggataatcattaattaatttataaatgtcctttcatcttttagaaaaatatattaaaaaccttttataaattgactaataaaaatcttattttagctaataaaaaagtttatctcattaattttttatttcttttctttttcttaaaagtatttctaaaaaaacttattcaaataagcctttagtgatcaattcatttagactactcctcaaggattggattgaacttacaaaattttagctcaatattaatttgacctgccctagctaaaccatttttttttggcatgctccttgattgaccaatacaaatagatcggactatctcaaattgatagctctataaatttcatcaaatatgtcaaatgcacgactattttaagtgagtgaagatttcataagtgaaaaacgaattacttaagtgcatatgaagatatatattagatatagatctaataaacgactaatagatctaataaacgactaaggtttttatttcagatgtagtgtgaaatattggttctatcataaatgatatataaaactctcactcatgtttatatatactacgtatcaagagaaatatcacgtcaacttgagtctgttacgcagaagttataatttctaactttcggtcgacacacgtaaattttgattaaatgcggaaacacacagttaaaagaagaaacaaaaaaggagtttaaacacaggaaaagatttcaatatgcttcaattctagtgtgaaaatttgtagctcattgacgtaaaggttatgctcgggatttaggcccaacatctattacttgaaggtttgactaattaattggttcagaacttaggttagtctctttatgtatcataggtacgatttttttgatgaaatcatcacatgtacgattaatcagtcataagtttgattctaattatgtaatctgaagaaaaaaaataattattattattttaaataaattcgattaactattacacatgcacaccttataaactgcattcatatatttgaaaacaagggcttaaacgggccactaaaacttgaagataaccgtgttatgaaattagcattttctgtaattaacttcaacgtttattttttagtaatatcttttttttctccataaaagcttatattatttaaattttcttaattaattttaaacacaatagttagtttttttttgtacttcaatataatacaatagttagttaattacatcaacctaacatgtgtttatattatagtaaaaaataaattgtaatttttaattgttcctttaactagatcctgcttaaaaggagatctaattcaagcacattcaagtattaagtgtaattgtttttttaggttaatcgttcaagtttatatagaattgcatcagaactaatcaatcagataattttgcaagagtatagtgtgtgattctatctgttgttccgagatcctcgagtgattaaagttgcttaacaactaagcattgcaaaaagtagaatgctgaactcgtaatcaggaattccttggtcgatacatgagggcatggaacaaagggagctccaactgagcctaatgacgaaatccgactgaagggacttgagaagtgcactaataaataagaatctttaattgaaagattagtctcgtatcatgcaagtagacactcaaacaacaaaaacaaatacaatggtttaacttcatagatatatattttgttcctgatgatgagtctatatatgtacccaccataactccacaagggtcatgtgaggtcacaccgctgtgtcctaacacattgtaacaccaaattcaaaaggtttaatgaagataatttaaatattaaccaagtcatttaaatcaacaaggtactggaaagtcatgagaagaaagaaaaattgcaactgagaatacaagtctgattttcccattacccaaaatacaagatatatattgaagcctatgcaaatacgtcaacataaaacctggtcaaattctgcaataaaaaaataatgaatcatactaacactccatggaaatggaatttaatgatattacactaagtatttgtcttttttttaatcatgacttaattcatataatatcgtaaattaagaaacattgtattaacaaaaatacacaatattacgttgctatctaaatggaaagaaatatgtataaaatcaacaaaaagacctatgaaatataatattaataaacctagttcaaatacttaagatgtaaatatagtgcgcaatatttcacatatatttgataaattattttttagtctaaaattaattttaaattaaagtaattttagataaattttgtctctgatgaaaaattatataaaacttactattaacttattgttaaacattcaaacataaatgagtttacttaaaaaaataattttaattaaaattaatttaatttaaaatcaatttacatgcttattcaaatattatatgtgtgtttagatgagatttagtaaaattaattttaaaatgatataatttatatttgtatgtttttttattctaaatggacattagtagtaaaactttataaattttttcattcaatacaaaaattacttagtgtatatagataagtatcattaaaattgattttgaagttatatgttttatgtttggatgttattttttttatcaattctaaaactcaaaattctttaatgtgaaaacataaaaatttatttaactaaaaatgatatttcaacattatagagaatctaatctgacaccatgccacacacttaaagttttctcaattcaatcaattccagatgcaaaattgattttttaacataaaacaaacatatgaatattacttaaaattttgttacctgatatttcaaggtgattctaaatcatttaacttgaatccaaacttaatttgtcttaaattcaaaaaatgcaagagttgggttgagtgagcaattgaaaactcaggtttcaagcatgagagaaagagaaacggggctgaagtggagggaaacaaatctagattagattctagcaggataaaatgccaaaactcaaaatccaagaagcaaccctgcagctatgcttcaaaaattcaagctttccaagtttttgcgtgcaaacttacgttcacgtccctctccttggaattgaatgaaaccccactcattaacaaagtcactttcaaaaagacactttcattgtcccccctcacctttttcccatacatgaagaaaaatgaacggttaatacattgagcatgaaagttgacaggtgaaatcccaaaccccttctcactataccctttttcttttattttccaaacattacacaaggagttactaccaaattattattttcagtactgagagttggagggtctattttctgtccataaatacctgtctcataggccaccccacttccatattttgcaacattttctcctcacatgttacataacaccaaagaactacaaatagttctcattgcataggtacaacctaattagctagctagatacacacccttgtttctttccattctgtctttgattgattattatcttcatatcaaggacaagcttaatagcttatagtttaatgacctttttattccaaagcttcttctttggttctcctaattaagttcatgcatccttaatggagtgatactccaaattaaataccaactttcggtgttttactttttttttttttttgctaattaaattttttaactagatagctctggttgcagccatagatggagtttcccaacgaagcaatatcagaagggtgttcacagaagaaaacgggaagagggaaaatagaaatcaagcggatcgagaacacaacgaataggcaagttaccttctgcaaacgccgtaacgggttgctcaagaaggcttatgaattgtctgttctgtgtgatgctgaggttgctcttgttgtcttctcaagccgtggacgcctctatgagtatgccaacaacaggttcaaatattcttttactactgattcaacacagtacttttcctctccttcaatctcatttcatatcttatgaaccatttaaataacacaaaccatatctagaaacaaaaagggttttatatatggggttaagaccttttttcttattatgattatttttgtttgttatgtggtatcatatataactgaaaggcatagttagtagataatcatatgtcgttaaaagtttaattttttaatttatatgtatgaaaaaatgtctattaaaagatgctaattatttaaacaagcattaatactttgaaaaattagtttttttaacttctgaccgatgaatactctaggttcaccatgtatatatcattctttctaactgttgtacttaattgttgctctatcacgcgtcttcccagtgatttttaagaagggtgcagatctgtgtaagcgatagaaattatagacgttaaggtgaaacaatatgaagtatgtagcagatgaagagaaagctttagttagggttacaaagatttgcaggtgagaaatcttagcttcctggtgtatctgctattgttaagctttaccaatccctctctcttgagtttctctctccacttgtcatccatcaaatcttaaaagggtctgggttgctgcacaaagctgtcatgcactcaatgagccccttccatcttgactcctccttaataccacttatttgtcaatgtatagtgacacaacacaagcatctcatccaattgggagttagggtttcagacttttcactatttagtatttagtcacacctcaatcacttcaattcgtttttacatatgtacacaaagttggaggaagaccatttcaattctaatgtgatagatcacggggaaatgcgcagaaactgcaaactaattaaataaccctttcagacttttattcacatagtaaacttgtatattttttttataacatcttttttatatatatctttttattgtataatatttttattacatacaaaaatttaatttgtactaatatagtttctctttttaagaatatttttatctccgtacaatgaggttacacgaagaagcaatcaaatcagatattagggctcttgattcaaaatgggtacagttttctttaaagttgcaacagaattttcacaggattaattgtttatgattaattaaggtcatttttagtctataatgcttcaatattttttaaaattcttactaaagtattcgttataaactctttttgagcataaagtaaatcaatttaaactaataagtatatcgagggttatggatgtcccaatttgtttcccattttcgtaaattttgtcctttacataatggaggaaagtctaatatggttagggcgtttcccagcccatagggtattatttggtgattttactttaaataacttgaatttcttttgggtacgtaaaacaaaaaacaaaaaacaaatgaattaagatgaaaaggcaaacgtgtaagaatttgattttgtgcataaaactagaaaattatgaagtgtagagaaacaacttttaggagaaataaatatttttagaagtgtagagaaacaatttttatgagaaactacaacctcattttctcatcctcatctcctatatttttaagaaaatatatcatagtgtttagatattattattcccgcttctgatttctttaccctaagtagctaaaagtaacatgatgatagcagattctaagaatggctaaaggcaaattaattctctttcccatatgtttttattgctttcatctttgtggaataaagcttcccattcctgacgtcaattctttacctattctctccattatatatgtgttttggacatttcaattaaagagaaagttaaacttacaccggcccactgatgcaacatcgacctcttcctgcatactcagtaaataaccactttgtatttgaactttagagaagttcagacagatggggtttaccattctttaagatcaaaagaatgaaacttcgtgtatttaaccatactcaatcaactagcttgttaatttttgtgttcttaatagaaaaaatttggatagggcctaacactgtaaggtaaacaaagaaattaaagcaagaggtcactgagctatttatatgaaagagaaatattaataacatttttttaatattaattataattatgggtaagattcaccagataagaagatgcacagaattttataatttataataattttcaatcaataacaaagaatgtgttagataatttgttcctagcatttctcttgcatgtaatagatgtaatgtaatttgtcaatttcatagattccaatggacattgaaattaaaaattataaggcttaaatatgtttttagttcctataaaattagcatgttatttggttcttataattttttttctttgctttccatccctttaaaatttaaaattattgatttttcccctttaaatatgaataaatcttaattttggtccctataaaacatatatttttttttattttaatctctagaaatcctttttaagatattacatgttaacattgtaccatatatatagacactagctgttgttacctgggacggtcacttgacattccgctgaacacataagctattaacgaatgtcacacaataatagagataaaaaataaaattttaaatttttgcaggatgaaaattaaaaataaaattataaggacaaaaatcaaaattactaattttatagaaattaaaaacatattttgctaaattataaatatacacccatttttattacaatctcaaagctttttggcctaagaatttaatgtcaaagaagatgagttcataattaatttgtaaactacagattaagtcgacaccgtgtacgtgttttggtaaaattagcatgtactttatcacatttttatgtttctatttgttgtattgttttgcagtgttagaggaactatcgataggtacaagaaagcatgtgctgcttccacaaatgcagaatctgtctctgaagctaatacacaggtaaatttagtaagctaaaaaaaaaaatcaaagaaatgatagaaaatgctcttgtttggttaatttggtccagaataaatgttgttttaaaattacggcatatttttcttaatagaattacagcgtacgtgaaggttaattatttcaagctgcaatcttctcaaagccactaaaatcctttatcattaggatactctaatagtctaatgcttagttttgaatgtgacatttacgagttcaaatgttcaagggacatcttcaccaatatttgacagtttggtattgagaggtatgatgagtcccacacgagacaatgttaaaatggatcaaaccaattcaatccaatttaatctgcgctctcaactcataaaattaaaaatggattggacaaattttaagaatgggatgaaaatcacaatcgatccagcccaatcttagtgcattatgggttggattgaattagccataattgtttttaaatatataaatattatatatataatatttaactcagacttatccaataaataaaacaaataaatactttaaaaaaatctaaatatattgtcattatcataataatactatcttactaaatagtcttagtataaatgttgtttaaaatttatcatcatgaaaaaatataaagtaaagcaacaaaataaataatagttcaataaaatcaacacttattggtataattatgtttcttaactaaatgattcataatatttttagatatgaaataaattatattagaaagaaaaaaatatccacttaatttatatatattcataattcttgaaaaattaatatcatactaatatcattagaaaaaaaataataaaattatgtccaataaaattccaacaaaataattcacaaaagaatccaccttttgacccattgagttaacaagttatgtaaatttaacatttaattgcataatgcaactcaacctattttcatgagtttaggatgatttgtcgaaatttaacctattttttacaatatatacaggttgaaacagttagaaatcagttatctattagctcaacaagataacagttaaattagttagttgctccttcagttatatatatatatatatatatatatatatatatatataattatgttacttttctctctcatgatatatcaataatacacattattttgttaatatctctcgtgttcatgttctctcttcacttgagctctatagactgtatcatgcatgtttctcaacacataattcaaatcatcacactgaaaaatgaattatttgttttatatataccttattctgcgttctagttaaattttaattctcctatcactaaattaattgctatatcataatgctcctccacaaggtttctctaactggttgacactatttatcaataccagttttatcagcaggaagcgtccaaattaaaaagacaaatcagagacattcagaatctaaacaggtcaatgttccattctcttaaaaatattattcatcagacttctccattgaaatgaaaaaattcaatgtgattttttgcattccaggcacatccttggtgaagctcttagctctctgagtctaaaggaattaaagaacctggaaagtagactggagaaaggtttaagcagagttagatccagaaaggtattatattatcagcacgaagcatcttaagcttctaaatatataggcattgtgaatttatgtagatatgcaagaagttagtcaaaaactagcaactaattaagataatttcagttagtattttgaaaattccaagttagaatgtctctattcctttggactaactacgcactccaattctttcagcatgaaactttgtttgccgatatcgagttcatgcaaaagcgggtactcatcatttccttcgatgctattagtttctgcttaatttatttgcttcatacatatatatatatatatatatatatatatgtatgtatgtatgtatatgcatatatatagtatctaaagaaaatatatcaaagttttacgatattgaaaccaaatgcatattttcaattaataggaccaagaatatgaaactgaaacgggataaacccagaagaaattccaatattcgtgaaaaataaagtaaaaatggcttgattgcttcgtacgaagggaattataaaaccttgcaaatttatgcctgatatttatattttttctaacatgaacattatacttgctgaaaaaatgcaggaaatagagctgcaaaaccataataattttctgagagctaaggtgatcatctcttaattccctccaagactctatatataaagtgtatgtcgagatgaatgataattaataatatatagttggtggatgatgcatgcatgtagatagctgaacacgagagatcacaacaacggcaacaggatatgataccgggaaatgtgtgcgagtcaaccataccttcacaatcatatgaccgcaatttcttccctgttaatctcatagattccaataatcaatattcacgtcaagaccaaactgctcttcaacttgtgtaagtacactcatcttccactgttaattacaagttgttgttattgaatgcccttttaataattattaattgatgaaaactaaaacaagctcgagggccaatgaccaatgaaacaaacaacttaattgctttcaacattgtaccaatcctttatatgcatgcaaccgtatatgcattacataagatttttaaatggctactaacaacatgggttttaatgtgggaaagtggttagtggacgttcaacttaaatggctcaggctgtgtttgtattgccctttagcagtttgaacgccaaagctttctctcagtaaaattgtggttcaacgtgcattggaacataagaaatagttcgacttacatatatatcattttacttgtttttaagtcatcaatgtaggatttgttattcagcatctccccaatccaaatggcatagccaagctataacttgttttcaatagtcaaccagggtaaatttcacatttgatcgagattcaaagatcatagctcctactcaagtctttttttgaaatcccttttcctttttttgtatatgaccttgttttcttttctgggcaggtgggtttttttaattttctttcttaatactgtttctctcttttggatttagtcttttcttgtatatgaaattttttaatagaaaaaagatgagtggacaccaatatggtaatatctatagttaaatataaagagaaaaagtttttttttaagcaatataaagagaaaaagttagagacaagtataaataataaataatatgacttggtagaaagagatgtattaaccttttatgccgtgttttttatatacaaatccataagttcatgattttgacagatgattccccatggcaaaaccattttgatatgtttctcacttccttaaattctcacctttggatgcagctgataagtgatttgaaattatgccacagcctttcaagtggtgtgggagcccttacatcgtcctatgtttcgtgaatgaaagtgcccttagaaattcctttgctaaagttcttacaacggagaacaagacaaaagctaatcagcacttgtaccaatacatcatatgatattgtttatgtatctttcaatatatatagtttctattcagtcctggcatattgtatttttatgttataaatgcttatttcaatatgaacactatacctatcgaggagtaaaagttaattgggcctccgcattattcatcatatataatttctccattatattccccccaattatataattctgaatatacgaaaagcctgaataattgcatttttttttcatatgccgtgatcactctccgctagttggggaaaaaatccttgttttgaagaagtcaggcttaaaacttcaaagttggacaacaaagaggaggattaagctagatcagtgggttgcttctgattctcaagcatatgaggaataacacaactattgtatttgattgtgttgcaagtcttacgttgagtaaaataaaaataaaaaatcaaagtgaataagttagaaatgtttgagtttattaagtttagacttttaggagaacatgatacctaaacttaaaacattaacgagcctaaccacattctattattaggcccgcaatccataataaattgttcggatagatttccttataaacacttctagaaatgaaaataagaaagtaaacttaaacgaacttcaattcaccctaggtgaaaattagtaagttcttttttttttaacttctttaaaaaattaattttaacttatatgtaacctttgtcaaaacattatatataagttaatttttaatttgtgtataatgtttatttcatttttacttattattttttctcttataattaccagaaaaattatccaaataggtacgtgttttaggtataagctcttcggctgcatgatttcaacataacttaagaatatacccattcacgtgagagaaaaaatcacatagtagacctgtccattccctccagcttacatacagaaattgcattaagtagtaatccctgttgtcctaaatctttaagcagttttacttccaaaatcctcggtttcttgcagtatatatagtgaccaaactcggcaacatttgttaccggggtctgttccttgttgtccaggttggagtcacagtgaaattgtaccaatcaattgtgcaggttcctttgcctcctttttgaaaggtttgtagcctcaaagtttatataagattaatgttatcatatatcaaattttgacaaaaaatttatacaagaaagagagatagaaaaacaataaatgttataagataaatggtactataatataaataaactgttagggacaaagtcccacatggtgagctttgcttttagcttgcactccaaagccataaaagaaggcttggtggaccctttgttcacatcccaaaatcatttctcttcttcctttatttatatagtctacttagagaagaaaaatatgaaaaaaaatagtttctccgttcttttagtagtagtattttcctctttggtagtgtcaatgtgcttttcttgtgttcggagagagaaatgttgtactttctttcacttaattagtaaaattcttttcactcattatgatgtcatactcttttctcatctcttattttaattgaattataattttgttacttgtcacccatcataaccaaaaaagtgaatgggtaaaaattattttaaaagtttggtgttgaagtgttttttctaggaagtcttatttcaaaaacataattataaagattcacacgtcaaattctgttagggccttttgactcaaaatctcctcccgcatttaacttttagtacaattactttatataattgatgttaaaagaattatttttatttagaaataaattttcaaaagttaatttagaaaatttagtcttaaaaaaatcatttataagataaaattgtaaatatatgtctaaaattatgtggtatatacatctaaaattaacttttattacctagaaagctaaaaaaaattactaattccaaaagcaattttattttttaagacggtcaccattaaaacattattactagatacatattacaaatataaaataaattaaatattgatcagtgtcttctacgggcatattaatttttgtttttattttatagttcctcttattaaatacgttggaatttatattgctattatttttatttaaatttcaattaaatataaaaaatatatagtgctagtgttcatgaaaataattggatccatttatatagatgcagttaaagtaaaggaaggattaattctcgttcatattaattattcaacaggtataattaatttaaagagaaatataattagggttgatttgagaataaaataactaaaacttaaattttgattgataaaacaaaatatacttttaatttttataaaagaaaaaaagtcacgcatatatatataaaggctccaacattatagctctcacgtataaagtgaacaaaattctctcaaattttactttagccacacttgtaaattgttggggaccgaccctaattaagtatactaatgtaaaatactcttttataaaatcggttactattagaattaatccttcttaaaaacacctgctttctatatcaattgattttgcatctatatacctagaatcaatctagaaaattaaaaataatcatactgaaaagggttaataatatgtaaggagatttgttaacccttaatttaactgtaacattcaatgcaagtaaggatctaaaatccaaaattaacaagatacaaatgctgttcaagtgaaacaatatctccattttgaaaaacaaaataatttactagactactggattatgatgcttatatcttcatactcttaaactgtagagctactgctagcttcttctaacagggtacgtattgtatacttgcttcatctatttgctatatatttatatatggacatgcagggagcattaccgtaagtcagagactgaaggcaagacattctttcctcttatcccatacggtatcattctatctccatattggaggtggaataactttgtctcttcacactataatcctacatttgctaataaacttatcggagaaatttacatatctagtccataaaattcgaacctcaggtaagccaatttcaagccacggctttgctgggccgttgaaatgaacaatagcagcagcttccacactctctatgctattgctaatttcttctgatcgatggcgataacccaaatcagtgacgaaccatgatgaatctatggggtgcacttgacccgcaaaagcaatcaaggcaggtggaagcactccaggattccataatgtcaacccggactggacgttctatgtcaaatttcaaatcatacaagtatacatgcagttaattagtatgatcatcagaattcacaagacagaagaaaacagcaccctccatgataaagaattgaatatagtgggcaattaatatttctctctctcaattataagatgactaatgatagatgcacacctacataatgtatatacttactaggatcttaaatacaagcaatacaaattctttatttttttatttcaaatataaacaaattttaattatatgtgtcttatttaataagattatctctaaaatatctttcatatttttcatgtttaatattaagtttcaataaaaaataatttttaaaaatatttatttttaattaaaaataacataatttaatgagttaattaatttttttaataaataagaagtatgttttaatcaagaccgaaatatatatatatatatatatatatatatatataataaagtgataacaatattaatttttttttatcagtcttgtcactgatataccacatgcatcacatatctacacatttttctcttatatctctatttctctttaggtgtctagcagtagcgcattagtgtccatggattatttaactaagacattataatacttgcttgatatttctcatagtccatacaaactaataaaagatttaatgaacatttcaaatcactcgtgttgatgttcattaagaatgatgagacaaccgaattaagaagtaaaaatgtgaagttaaaggattatcttgctagctagtaccattttgaagcatatggaaatttgtcaaaacacattttaaatagaaatgcagttgcctaataacttccttatgttcatcaaaatatacttacaagtttcaaccattgatgataggtcttagtaatatttgatctcctccaagcttcaagatcaaatatattcacgccaaagagccatgcacacttatcaccatcaaagttggatgatatgataggatgtgaaaaattcaaaaagctgacgtatttgtttccagggcagcaactgttctcacaccatgacttgaacactgaaccactgactttgccattaatatctagttcccacaaagaagatatgtcatgttgtactacaacatcatcatccagcaatactaccttgtttagatctggaaacagctgtgatggtccacaaaaaatcagattatgaaacaatcatgaattattactgagcattcgtcttgttaattattactaaaatttattcaaggttttaaattacagtcctatagtttcgttgagttccttgatattacaggaaaagtggaataattatcaattttggggagtcttatttctaaatcatgaaagggagttattaaatgaaacgttaaactcaaaaaaaaaaaaaatgtcaataaatttcaggcaattataaagaaaatattagaaaaatagtaacagagactattattagcattgctcccacaggaaattgcgaactaatgcagtcatgattgtaatcgcattgcagttgcaaacaccacaaaaaccttccaactttgaaattgtggttgcctactattttttaaaaccttgatcaatcttagggctagctaaagaataaagaaaaaactaacatgtattacctcagggatatagatgcgaagatgattcaacaaggaaaggctgctgggccttaaagcttgaaaatatctgttatgctcttcactatggtcaagctccttttctttatagttgttgtcgtagtgcttccaaattaactgatttgtttcctgcatctctctaacaccagcgttcacttctttagaccaatcatagtggtgtaaccctctaacttgtacaactgctgagttaatagagttgatggcaaaccaagtatgcattggagtataagttttcttgtcagtaacgacgtgaaaaactagtcttccagggttggctgaattttcaacagtggaggttacaaccacggaagctgcaaggacgttgtcggttaggagaacaatgtggtgaaaggtgggatcaactaggcgagagacatgttcaggagaaggtagacgagatcgtgccatggcatttacggcgtattcttcagccaacttcaaacaaagacaatgcagactttgaggaacaccgtgtgaagctatatgccaattaagtgactccttctttcttgctgattgcacctcacgttccatctgtgacagctacatatatatcaacataaaataaaatgacatgtcagacattatactatatcctaagagtaatcaacaagcaaaagattatattaacaacgtaaataatcagtaaatgttgtgtgtaccatggctttggtcttgaaagcaaatgccttgaggtcttgttttaacgcaaacactttcacaagctcgttaaatgacattgctcctccttcattagcattgccatcatttgcctctattagcactctggtcaactcatctctgagtttcttcatgcacatacatacagtatcaccgtaaaaaacgagaatgaaagtcacggaaacgtaaaaatatgagagaaaaaataaataattttctcatttatatttttcatatatatttctttttcctatatataaaatctagaataaattaaaattttactaaaaacttacaaagctataaataaaaccatttatgtgcttttaccaaagctttttcaatcagctttataagataatattggagtctccatataatatggttaagaatttaatcaatccttactgtcctcattattctaaataaaaactaaatttcagaacttgcaatttgaaataattggttcattgccatgtataaataaaagttcaactttagcgtaatttaaaatagttggttctctgacatgtcaaatggtaattaatctgtaagcttagaatatatagtcaaatatcatttttatcaaaatatctctgaatctttctaacccattttctgaaattttaaataaattattttaacaattgttgtgtccgtaagatattgattacggttttttttattaaataatagattatatgtttaatatgttattgtcacttatcatttgatagtcttttttctaaacttttattttgtcttcttattttctttttgtcggatccccatatgaatatatgataaaaaaaaagacaaaataaaaaattatggcttattatttttttctaaacttttattgtatcttattatttttcttttgtcggatccccatatgaacaatatatcgtccgtgctggcagctagtgttcgtatttaaattcattttcattttaaatttataaaattatggcatttaacttaacattattttttacaacacataataaaaaatacagttaaataaataataataagcttgtttattaaaaataaatatatatatatatatatattagtgtacttatagttgcgtttattttataaaaataaatcatagaaatttaaaaattatttattccagcattatccagctcaccttaaaacgaattaatgatcatacatttattaaaaaatgttatccaaaggattacttataagttgtttattcaaatacaaataaacaagtcaaaaataataatagattggttctaccagattggcgtcacctccgccgaaaaatgtcgatcccacgcaatctgcaacaattacaatggttcatatatagatgctgccataaacttttcaacaaaagatgagctcattttaaggatgatttaagatttaaatttatctttgtataactttgagttaaacaagctaaatatgtaagtttaattttgatgtcctatcagtgtgaagatttttttataccatctactactaaaataataactttagtatgacaaaaaaaattataaaaagaccaaaataaattatttaaaacttaatgtatcaaaatagaattttcaaaaatataaaaattaaaatcaaatttttaattaaaacttaatatatcaaattaagaaaatagatcaaaaattgcatttaatttaataaagtaacatgaagagtgaaactttcattctatcaactcttttaattagacacctttaactgtattttttttctcttttatacggatatgcatttaacatattatcttatcaatgagataaaaaaaaaagtcattttcaatcatcttaaactagtgatttgattactgattaagatttaatattgattggtgattagtgatcttaagtgcacatagtattatgagtgcatttgataatattattatttccgctgataaaaaagtacattttatactattctcctattaaaactagacttttacttcactaacatatattaacctttaaacctttaattaaagtcaaattttattacatagattattaagataaagctttaattttattgaagaatcatgttaaaagcatttataaagctacacctgaatattaataaataaaataacctattagtggtataggatttaggagttaattagggaaacattaaaattaaaggtatctttgtataatttataggtattcttcattgaaaataattttattcgacttaaataggattagtatatatccatgactcaaatttaaaataattgattaagttaatccatgtattccattaatagttaaaaaattaaaggtatcacaaaacttaaactagtttttttcaccttttataataataaaatcataatatttgtaaagataaaaagtgcttatttaaatatattatttcaaaatattttaattaattttaaattccactacacttttatcctttcgtttgttttataaatttcacgtttaaactatgcacagaatctgttttatctaattaaattgaaacaactgcatttctctatgaaaaaataaatatcaaaacaaaaagaatgttattgcatgtgtttatatataaaaaataattattaaaagttttaattgcagcaaatacttgttattaaaaaattcatttcaaaatgtttcttaaaaaataccagtattattaaagtaatcgttaagagaattttgaaaaatagtaaataaaaatttccttgagattattatgttggacctaaaagaagccaaatgaagctgaaaatagtaagtttcggtatttattattttcactatgattatatacactgaaattcattcatatgtacttgtcccacactcaactgttttccttaccgaactggctactacaaaaaagttaacagtaaaagaaaaaagaaaaaattacgaaccaaaagtaaaaaaatgaatcggaaaagaaaaattaccaaaggtggagcacaccgcagaagattccagcaccaaaaccgccactctcacaaagctgagcagcaacacgattccgagcaccaccaccatccggttggaaatccggcgagcggggacggtgtaggcaggagcagtggtcttggcggatccttttccggcgacgagtctcttaatccgctttgcagatacatagagcttcatcttctgaattccattccctataagctatatctggctagctttctctccgatcgaatcggcaccggatctgagtgacgaagagagtgtgtgtgttgcattcgtgtttggatcggtttctgcgattgaaatgagggttgagttttttagttacggggaaaagaaagaaagtagtagttgctgaagtgagggagataaagaaagagagtggaaatgcgaaaaccaaagtcgcgggaaatgattaatatagcaattacaccttggtgttgcgatctctcttttcgccactgtttttcacgttatttactcttttgacactctttcgccgacacctccatgacgtgacacccgcttcttcgagatgctgccggtacctatgaggctataaccagtatttttcaatttcattttttttattatttggtcattttattttttcaaaaaagaatatataaattgatagacataatcaacattttattcgtctgttgatatgattttatttttatttttcatttataataagtgaaaatattttaaaattaaaaaaatattaatactgcctccttctttatatattagacactttttttaaaatctatttgtttttttattatatttttttgagttttcttttgtattaatctttttaattaaaatattcttaaattataataaatattataaattaataagataagttcatctattatcttataaaaattgaagaaaatgattagcacatataaattaattagatgaaaaataattaaaaataaaaataaaaaagtgaggcatatcttgataatttttaaaaaataataaaattttaataaatttaatattactaactaaattaattaaatttaaattcttaatatgtataaattaattaaaagtatcttatatttaaagacaaatggagtatattttaaattttgcaaagaaaagtttttgtttaaaaaataatagcgctaatgataaaaaaatatttgtatttacttaaattaaatttaataatttaaaatttgaatcttattaactaatatcttaaacatattggttaaataagtagtagtaataataataataataataataataataataataaaataataataataataataataataatagcagcatatcatgctaaaaataactcggatatactcctatattaattaacagtatttttaatagcagtaaaaaaatagcatttttagtaaaaacttatacttttaattttttattgatgttctaaaaaaattattaaaaacttttaataatttactatcttttggaaatctaacgtttttaatgactattaacaaagaagtactaccactgtaccactttcactcgttttttgtttttttaagaaattaatgttgaagtcggcgatcctgtctccaacctccacgtgttgttcaattttttacaatgcggatttgggctcttataattgtgtatccatttttaaaatattaatctatacttattgatcatatcatattctaaaactatatattatggaatgatgtgtgcaacccaacgctagatgtactcagaaagcaatcacaagtaaaatatctagctagcctctaggtatatatttgggcttatttattttagagagaaaaataaacaatactattaattattaataaataagattaatagctaatattatgtacatatgcaataaattatgactgttttaaaatattgaaaaaaaaatcatgagatatgcataatttagagaagctagccaaatctatattcagaaaattatatatatatatatatataatattcaaaatattaaatagcatattttaaactacttgtaaattattattattattattaaatttgccggtagtagttgattatcacaagttctacattttgcatgggttttatcaatgatctcctaattaataaattagatttggatggacatatgaaaaggaatctaccacttatatttaattgatgttaagtagtagtagtatttggtacggcatacggccccagtttttaaaacgttgtgtacagccacacatctgaatcaaggttttaaaaatcatagtgggagctgaggcgaaatggtataattaattataattaatattattatttttattttaatataatatattaaataatattaaacaaaaaatcacataatatttataacttcataatattaaaaaataaattaaatttataaaattcatgactcataatatataatattaaaaattaaatatgaaactaaatcaaatatatcataatatttaaatttaataacacataataatatttattagtagtaactacgcttaaaaaataaagataataaacataattatctttcatcataatattgttttagaattatatcaacaattataatatcaagtttttaatttaaaatataaaatataaatagtttttttgggcaaactgattcaaacttggatgattcgtccagttttggattagttcaattggttttttataccagtttttttgtaagactgatttctagagttaaatgaactggtttgattattaatttctggttcaaccagtgcatgccaattggttggtttggttcaattctaatactaatattaatctgaattattaataatttttgcgcgcgtgtgaaatcttaattaattacttgtagttcgatgccaactgagaaaacataatcctgtttcatcattaaccaaatttacataaacttcaacgactgtatgttagatcttagtcttttttttattttttttttattttttatttttacaacgactgtaggttagatcttagtttctacaccgagatttttccgccaaggaaaaaaaaaatggttattattagtaagtgtttacctaaattttgaaaaatgtagagttctaaaaaaatatggcaagtggtagtgattgtatacctaaagaattagataggggtgcaaacaggtaaggatgacacgtaaagaaaaaatatataatgggaaaaaaaacttctagatgattttttttttttaataaatactactatatatcatttaaatcctctctttctaccaatttaccccgggatttagatcctctcgtaaaacgatatgattacgttggaaagtaaaagacataatagaaagaaaatactactataactagtaggtttaataatttatctgtctcttttgtcattctcctttttaataaaaagaaaagaaaagtagtaattatgtatatcgtgcaatgaacaactatatttgtaaaaatgtaaaagttaaattaaaaatattatataaaattaactcaattgataaataattattttaatgataacggatataaatatacaaatatttaaaaccttgaaacttttaaaatctcaaactattctaattaacaaaaaaatcatttatgatttacaaattaaaattctattataatttacattgatcaaagaaagttttcttcaatgaacgagaagcgtgaattaattacaggtgactattatcagaattcggttggatacaagtaattgtaagttgatgaggaaaatatcataaatctcaaaaagagttaaaaaaggaaatccataagtaattaacttattatagagcgaggaaactaagtagagaggagagagagagagagagagagagagaggagagggagaggagagaggagagaggagagagagagagagagctgcatgtgctctgatacaacaaacagcaagcactcatatgttaagtggaactaataggtctagcaatctataccatgcattgatgcatgttgatgcaatatctttgtcaagttgcttataatatcaatatatcatacgaatgagttttacaattggtacgtaggaaaattaaaaatcaaacacatgcattttaagtatctattagtttggtttcttttttttattcctttttctagagtcttatccattaattattttaattaaacatataattgaatgccttcatatatattcaattctccctttatttcttactcgtgtaccgcccttaaaaattgttataaagccctcgaacgtgatataagactaccaaaattctccctttaaaggactacgacatgattgtctgaccttaatatctcccttattgattcttgatgcagaattggagcaagcacatagatgagttgagtggtaaagaaaaaataaaaactaaaaaagtctcaagtttaattttccctgcaaaaaaaatcaataaattaacaattaatattttttgaaaaaaaatatgctatcttttatctttggtcaataattaaataataatgtatagacaatttttttatgaatatggaaaataagcacctcattaattattcttgaattgtatcacaccaagtccactatgataacgttatttatttacgggcacgttgattcaggataatatggacgtgaaatatggcactcacgctagctaccttgagtcattatacaatgaaatggataaggatgttgtggctgtacaatattcagtttttttttcttcaataatgaaaaatgttattgtggcaaaaaaaaaaaaattgcctcacattcctcacatcattaggatgataagtggatagaattatggatttgaacaaaattaataagttaaaaataattttaacttttaagtccgtcctttttcgtttgtgtgagagagatatgattttcattcaatgtatattatatctttatgtcttattcactattaacattaaattcagtccttaccactttaatctccagtccatatgaaacatatgctgtcttttttcacctatatatatatatatatatatatatatctacgtacttcttgactgttgagctatcactatctatggcttcatgttatatatgttatgtcaccattttaatgactcattagacattttttttagcttgcagtgatagtgtgaaccttgtagatttatcatgtttatggactcttcgcctaattaaattctattttatgatatacatatttaataggattcgatataagctctgtttttatctctaaattaactttagacaacatttttacattctgtgtgtgtgtttttgtcaatttcgtctatattggcttctaaatataattgttaaggagaaagtaataatacttgaatctcacatgcatatatgtgtctattttgatcgcatgtgaatcacacattatttatattgaatttacaacaaaaaatttatttccatccttacaagtttggtcgacatttcactttagttactaaaaatgaataggcaaagaaaagttataattcgcttgtgatcaagctaggtgggtgcaattctagctattcttgtaaattttcaggttgcttatgctttgaggttcagaagtattcaggaggtattgggtgatgagggataaacaacattggtgttggggtcattgcactagcgcgtccgcagaaacacagtagagaaggaccatcatgatccgcgaggaaatcatagctagcgaccatgtaaatcactgagttagagccgttgttgttggcctgctgttgcaattctgggttgtggcatgtactgctgagagaagatatatgcaaaacataacaagaaagagaaaatgcattggaaccaaagccattaaagacgagagagaaatcatactcttttttttatatttattttttaaatcagattaaatgttaaattacgataacattcttaaaataaataaattaaaatattaaattagtgatttttttggtcctacacagttttgtataaattgctaatacacatacactaagagaggatataagaatgtcaacaattttatatatatatatattatatatatatatatatacccacgtatacatatatatatgtgggtatcaaataagaacttttattattataagaagttaaaactctaaattcaaattgtataatcatacacggatattaaaaattaaaatttaattgtgcgtgactcttatatatatgatgactaatgaacttattatattgatcatctaggtatagttgtttgtcgtaggctaataatctaggcatagttgttggcctgctattgcaattctgagttgtcggatgtacttatgagagaagatgcaaagacaacatgcattggaacgaaagacattaaagacgagagagaaatcatattcttttttactttatttttttaaatcagattaaatggtaaattacggtatcatccttaaaataaataaattaaaatattaaattagtgattttttcatcctacacattttttataaattgctaatacatacactaagagaggatataagaagatctttaatggtaaattctaaattggaatcttaaatcactttttgattgatcccataatgttacataggattgaagatgtatcaagatctctctcatttgtttctttagtgatagatctaattttgagatcttaagaagaggaagagaaaacaaattattcttttttgtaggaaaacaaattattattttttgaatattatacagatcttctacgagaactcattcttcgtattagaaatttgttcatatgctttattgaaaaatttagtgaaaatcaaattttgaactcaaaatccatactcaagatttggtactaaagatactctaattatgttatatatgtatgtgactccaaaaaagagttttattgccatcgttttgtttctttcaagagctaattgtaactctaacatctgaatcttgaaaatgaatttgctcaagtataataattaataagacaaaaaatatgtttttaccttattctgtttgtgtgaaagagtgactctaactgaagagtctattgaattttaatacaagagtgagcttaaaaacttgcatgtttccaaaatcaacgtatttatatgtcacaaaataatctaacaaattattaaagaaattactaaagagtaaagacgcataagcgtcatgaaatcctaaaattttaaaatccaattgacaaaataacttatttgaaatcctaaaattttaaaatgggtaacgagttaaacaaaaagtagaatataattgaaaggaagaagaagaaaaatataacatgattaagcatattgaaaccaatatggaatctgctttacaaaggagacatatgaaaaggaggaatgtgatggagtgtacaaagtcaaaagctaaatttatggagcaaaggtgaaggtggctgaaggaaccaagcatgcacatgcacatggttgatgtttgttgtctttggtgcttctaaatgggcccacagttggcccagtaaatagttaagtgctccttgttctgttgttagcccaatatgagtcggaaaggtgcgggctgggacccaagatggaacttgcgtcacaaatcgtatcaacaagaataagaatgcttcttcattaggatcaaggttttttttttttttttttttttttttttataagtaaaacaactcaaagcatttcattggtaagaatagtcttaatacaagatgatatgtaataaaaaaaaactagtgactaacatgaaattgcgatgtctttcctagaagatgtacaatataatttgcttgtctcctaacaaaatactgaaaacagcaggatcaagcttgtaataaaaatatcggtgggaatttatattgtgagctcgtttatttaaatttattttgtaaaaagaatgtttttaatgaaataaacaattgtttttgtttttatatatttgtctaatttttttcttaatttaccccaaaaaaaataatgtcattgcatattagaattaaatccaaaggtctggcttgttgaatgtcatagaattagcaaatatagggtaaaaaactaatgatttctgccgaaagttaacttgcagcacagatactttaatgttttatgacttgagaatctttaaaagtgatgtttatatgatatgtttgtattcaaaaaaacattatatgtatttttattaattaaattaataaaaaatttccatgctactgtggacaggtcaaactcactatggatatacattcaagttacttgatgttccttgtgcataccttgctcaagaagataagattggtgagtagggagttgacgtacacattaaatcacaaaatgctactgtggacaggtcaaactcactatggacatacattcatgaaaccaaaatataattaatttataatggtagaataatagtattcactcttatttcaaaataaaagatgaattaaagtcacatttaaattgaatatagcttaatttacagccatgatcttaggcagaaattctataaattcagggatttctgcttctaatagaccaggaacttaaactaaatatacatatttatttcactttttaatataaatttaacacatgttaatttatatgcaatagtttttggtatgcaaaatggaaataagtttgtcaaaagtatttatatatataaagaagcaaactacaccagtatcttgtgatattctttttcgaattacgcataacataattcttttttctattgttacaataatatccttagaaaacattatactatacgcctattgtattacacaaattcccaataatatttgaaatcgttaaggtgggatattgtgtgtcattcggaaaaaaatcaggtgttaatgttaaaaaattatgaagaaggtaagggatgaacttagcaaaaaaaggggtgaaaacaacagttcccaaatgacagcaatccagcaaccgactaaagtgcaaaactgcaaatcgtttaccgcacagaacatttcagtgattcatccaatggattatccttgcacctagagattcaactcaacacttcagaggtagtgtcgattttggagattcaacactgtaggtaatctccttctgatttgaatgatgcatttgatttaacgctatcgacccttcatggtttaccaatcttctctcaagaaagtttttggtaaaattttgatcttttctaccctttctatcaacccttcttgcagcatgttgaagcgtggatacaaaccaaagccatggagtggagctcagaattgccgggtttctgtgttcctcatgtttttttcattgattctaatgttagtggttttccttttagtatttcgttatgacagtgatggtgctaatcccagtttagcttatgaacttcctaaacaaaaatggaatagctttgactctttggtgcatttgcatccaacaaaagagttccggaatggaactgatttgatatggcaaagtgcctgaatcacctaaaggtgttctctttctggctcatggatgcaatggcagggcaatcaacttctgggacaagtcccctgaatgccctgattgcattggtttgcctgaggaacggttgcttgtactccatggtcttgcccaaggttttgctgttattactatttcaagtgcacaaagatgttggacatttggtaaagaagtgttgttgttaaagacattatagagtggtggattgatagaaggaagcttgagaaacttcctcttgtggctttgggtgcttctttctggagggttattttgtgtctgtgcttgccaccgccgtaaagtttagtagtactgtgctcatgattgctgaggggatgtttgagcaaattgatgttaaaggggactaccgccgaccctttttgttcacatgcccaaagatctttataggcaagcagaaaatagatgagtatgtggaggttttaaaagataaagggattgatgttggtgttgttgaatgtatggagtttccattgtcaccaagtactttagctgatagaatccagggcttgatcaggctcttccagaaatttatttgagttctttcaggaaaagggctttattgataaaaatggttatatgaggaaagatgggcgtcaaatcaaatggaaaaaggctcttgaggagaagaaagctcttatgctggataagaatctggtccctcacatccaagaggagctaaaccttgcatttgcttaccatgagatgactagtgtgcattctggaccaaatttttaaatggtttgaatctcacatgagctcatcaaaacttacctgcattgaaaccacttgtatatgatggacctaaccttcgagtcaattttcctgaaattcaatctgagatccattgactcatgtaaaaactgctatagcggtttctttatcagagattgagtctcaagggctggaatttcttaattgggtgttactgtcagaagttatctatgtaaaaggtatgcctctgaaccttttgcaccaataccatatgtgctttggcaagcagtatgctgaatgttatcctagattttgttaaaattgtaatctttctactgtttttttttgagatttgaagcacaaatcattgtttaatctttgaaatttgaataccctggtggacttgagtttcaaaatacactttttaatatggctatcaaattatgagcctgaccctgcaagtttgactactagacttatttgccctatgatctaaacccaatttgacatctatacttgaataaaatttaaaataagaaatgcaaacataatttttaaataagaactgaaatgaataaaattgaagcgagttttagatgagggcttctaatttcaaggtgaagaataatgacagtattttaattaaatggcatacaattttcccttgggtttttaccctttgcttgtattgatggtgagaggtggaaaggagaaaaattatatgagatagtaaaaagatgccattctttggatgtttagaaaggaaaaggaatggaatcaaggagactcctttccactccacacctctctattcccttcaaattgacaggggagtggatggaataacttttgaaattatcttttttgccattcatcctaagatttaatgtgtttgatatgagggcaccatgggaacaatgaacttgtaattcttttaattccactcacttctactgtaattatgaatgggaagtgggaactttcttccttcctatcagtaaacatctttactatagtattttgagagctttcttcctttctaccaataaacatctaaattcttgtaattatatggtgctgtttttgtccctgcaagtggaggttctaagcacaagaatgctcctgaaaatggaagtgatgtggggtgaaaacattgtatattgtatattgtattttatgtgagatcttactatccttgttaggatcttacaatatacatgttcccctcctttccaatcctaggtgggatctcaatttgactaccttggacatatggatgacttcatattcctcttgtttgtcatcttaagcattcaaaagcttttggagcttaaaagttatatacacattggaattcttaaaattaaaagttttgggttcattcggataaactaaaataaatgcttttacatataattttcttatagttttttttatctagaatatattaatttttacttgtgaaaaagaaaagcacaacccaactttttctctgaggcttttgcttttttttttttttctccaaaaaacttatctaattaacataattttttcaaacatattttgaattaaaaaaatactttctttttaaatcacaaagaatttgatccatgttcttcgttttattccttaccattaacacaagtaaatatatcatatatagcaaagcaatataactttctagctacgaagtgactagagtagtagaggtctttaatatctcagttattatgttgctcaaaagtatttggtaagttgaagacgcgttttgggttttatttgtgtttgtgttttaaagatataatgaatctttttacgttacactgggaagactaaactagtagaggtctttaatatctcagttattatcttgctcaaaagtatttggtaagttgaagacgtgttttgggttttatttgtgtttgtgtgtttaaagatataatgaatctttttacattacactgggaagactaccctccttttatagtctttacctgccggtgtaattgttctggaccataccacagccttgtacacttccccttgaggcactttaaaagacattaattggagctcacatggcgctttaatccttcctctgccactgtaacccatcattcccaattcacataggggcaccattgccagcatcttggtccatctattgtctttgtttgcatatatattggcaacaaaaccgttcccttgaatttcactaggaaacaattctagacaacttcattctttacagtttgtaccttgttcacgttttcaagactcaccatatcattcttatctcttgaatgccatcatgttgcatgaacaatcgacatttctagactagggctatttctaaattacactttatgggtaatcaatttcttttgatagattatgtacatccttataggtggaccttcattaatgagaagatgatgcacccttttagtgctgtacttataacaatcctcagtttttatttgatgaattatatcacagattctgattttgccttccatttttagctgagttgaagtgatttttatataatgaaataagtttatcttaataagaattttgcattttttcatatataatgaaaagaagtttgtactttcgaatgcagatataattgaactattgaagtaacaatatataaactttattacagaataagaaacgataaaggctaacatgaacttgtaaagtaaaacgatatccatattacacaagataaaagcctaaataacacacttagaataagtcttagacataatattcttaactaaataaactgacacaaagaccaaattaactatatcatgctcgaggcttcattcgcccctcattagccatcttgaagaggttggcttgtgctgctgctaccttatttgaggcaagagatgctataaatctgtctctgacttgctgggttgtataagggaacctgttgttcaccaaggaattaagaaaggaagctgtcccttctctgtagagtgctcctagcccatcagttctagtgttggaaagtgcttgtggcaagctgagactggcaccaaatcctggcatactagagacaccaaatgtatggcctaaggttccccaccagcctagcaatccccaaatgattcctgggtgagtgttccagtagctgcaatttaagaggacaaggtcccataggttacttaacagtgtgctgtatatcatatcatagtttatagtgcaatgtagtgaaaagaagtagtaacttacttgcatgtaccagtgaagggagttgggaaggaagtaagggggtgtggagggatagtgggggtgccgggtcaactggggttgaaggtgggctcacagtgattggtgttgggggctaccacctccataagttggtggtgagttatagtacccacctcctcctgaggaggtttgatggtgttgatgggttgatggtgttgttgggactgagggtgttggagtagaggggtcatgtggtggtgtgccacagttgctgcctgagggtggtgatggggttggattgtaatttccaccatccgtgggtggtgatggggttggattgtaacttccaccatctgtgggtggtgatggggttggatcatagcttccaccacctgggggagttgatggagttggattgtaacttccacccaacctgaaggtggtgatggagttggatcatagcttccaccaactggaggagttgatggagttggattgtaacttccgccaccatctgagggtggtgatggagttggatcatagcttccaccacctggaggagttgatggggttggattgtaacttccaccaccacttgagggtggtgatggagttggatcatagcttccaccaccctgggggagttgacggggttgggttgtaacttccaccaccacttgagggtggtgatggagttggatcatagcttccaccacctgggggagtttgatggggttggattgtaacttccaccacctccatgtgatggagatccatgatgagagggtgttccatgatgagagtggtgtggtgagcttccgtgcccaccactcccagagcccatgatctggagagcagtatgaaaccttcaagaagtaaaagcaacgtatactattagattttaaagttaaatgtcaagatagtttctttaagagctcttgatcgttcatacgtcaaatttgaaagtaaatggcctactgtagctagcaaggaaatgatatcttctattttgcataaataatgaagcaaaatgtatagttgagtaagagaattacatagagaatttgataaaatctgttcctgcatgtgggtctggagagttgtagttcttctggtccacaatgatggcagtggtagatactacagggatgacaaggttctgagaaagcactccaagtagcaatgtgaacatagagaaagaaataggaactgtgtcttttcctctccattgtcactgactgct
